United States Patent 10,407,724 (METHODS AND COMPOSITIONS FOR SCREENING AND TREATING DEVELOPMENTAL DISORDERS) - sequence listing, part 4

SEQ ID NO: 62 - DNA, 131541 bp, Homo sapiens
aagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactgga

SEQ ID NO: 63 - DNA, 133838 bp, Homo sapiens
actgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 64 - DNA, 145035 bp, Homo sapiens
aaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 65 - DNA, 146701 bp, Homo sapiens
atttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 66 - DNA, 164044 bp, Homo sapiens
tgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 67 - DNA, 183907 bp, Homo sapiens
actgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacatttta

SEQ ID NO: 68 - DNA, 196831 bp, Homo sapiens
aagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 69 - DNA, 213430 bp, Homo sapiens
tcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccactggggtacacttaccacccccgcccccgtgtagctccctcccctatcctgaaatctcccttagcacactaagtattctaggttaaacagcccagatgttcagggagttcattcgccacaaacacacattaaaatgcagacaatttgcctgtgagatgaggaaaattctctggaagatttaggccctgagagctgaaaagggaccctaaacattacctggtgacaactgccctgaggccagagaagagaactcacaatattggtatattaaccggtaccatttgtagttaggctgtcattaatctgggtgtaatggggctcagctacagagaagcgtatccagaggaaatgtggggttcctgcagtcagctggggcaccgaaaagacccagactttagaaccagataaaggctgagttcgaacctctggttcttttgtgatgtggtgaccttgggcaaattaatgtgtgaacctcagtttcctcaactataaaatgtaatgaacaatacctaccacttactattgctgtgaggaagaaaagagagtcaacatgtaccgtgtacagattattgatgtaattcaatggttcttttccccatcctcctaggaggtcactggggagacagggggcagggtcagcccagtgccaaaggatgggcaggatctgaagtgtggaaatggagtaaggctgtgtctgtgtcagaggtgggttgggaagatgtgagacaaacatcacaattttgcctaaggtgaatccaacccacaagtagagcacaggccaacagcagctcactagtacacatacttacaccagcagctcactagtacacacacttacaccagacgctcactggtacacactcacaccagagctcattagaacacacacaccgtcagcttgctagtacacacacttacaccagaagctcactagtatacacttacaccagaagctcactagtacacacacttactccagaagctcactagtacacacacttacacccacagagacaagccccacaccacacggactcacaaatgcagaagaagagttgaccctgccctcatgtacagatagtatgctggtgtgtagtgagaggcggctagtgttcgcca

SEQ ID NO: 70 - DNA, 216081 bp, Homo sapiens
gttcagaatttcagagtcgaaatttcttgttggtggactttaggaatacgtatcattgctcctgagtatttctgttagtgctgaagttctgccccaaggacttcataagattaataacatcgcaaatcttctgtagtgctttaaaattttgttcttcatttttttattctcactttcttctctttccttttccacttcctcttatgttttccttaatcttcaactttcctaagcacctgcaagtgggattggagccttgtttaacatcgtccatgtagcaaaataaggatgaggccaaatatttgaaccaaggatccccatctcctatggaaggtgccctgaggttgtgggtgttgctggggacatgatgtcatggccagatcctacatcatgcggccaagggaacccagaactttcactgctctttgctactgcacatcagaacccatcgctgggagtgtcttgcactgcctgacctcaccatggatatctggctcctctgctgggtgaccctgtgtctcttggcggcaggtgggtccaggtatacttaaacatttgcataaagatgtttttggctgggcgtggtggctcacagccgtaatcccacctttttgggaggttgaggtgagtagatcaccagaggtcaagagttcgagaccagcctggtcaacgtggtgaaaccccttctctaccaaaaaatacaaaaattagccaggcgtggtagtgtgctcctgtagtcccagctacttgggaggctgaggtgggaggatcacttgaatctgggaggtagaggctgcagtgagcagagatcacgacatttcactccagcctgggcaacacagagagaccctatctcaaaaaaaaaaaagatgttttctttgggcttcccttcaccttctatggcttccgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtggcacagcatggctgagtcagttccctccagggtgcaaaccctctggctgctcttctcccagttgaactccaagaaaacatttgaaaaagcctcttccttatcttcctaccccagaagaaagaagcgagttgattgttgtggctgcagctgctaccgggagagtacaagaccatgaattaaggtcttaaatggtcatgatgggcacactggacaatgggctcctgaaactacccaaatacaaaatgagacattctgtggatcaggaggaatccacatgtttagaaggaagggccccagaccaatttccaagttcagagaccagctatctgaggttgatattacttaccaaaacacaaaaacattcctactgattttatctcaaacacagttctcctgcaaactcttcccccaccaacgtaccccagcagaggcaatgacatgtacatttatggaacagcctgttgactactgcagatccatctcttcaataagaccaactttccctggaggtcagtgactaaaccaaaccgcaaggcagacggcaacacgaccctcttaggggatggatgccagagaaacactgactaaaatccccactcggggactgtcctagcacattcagttcctcacacagctgcacaggggagcgcgacgttttattctgttacttcaaacactcatctgttcctctctctctcttgcaggccctagactcacagacactggaattagagtcagaaaaattgctttctaatcccaaaactggttttgtttactccccttcagctgtgaaatcttggcaaatgctcttacttctctgggactcagtgtcctcctcttcaaaattagagacttgctccacttagtctctaagatctgatacaaatatgattatttgacttgctatttatttatttatacaaatattagaatatttatgtatacatttaacataaatatatttatatttaataaaaacataaaatttataacattttatataaatttatatcaataatatatatttattgatatacttatatcacataagagatatataaatatatgcaaatatattttatgtaaattttaatacaaatataaaaaatacattttctatataagtatatataaatacttatatataaatgtattttatacatttatatataaatatatatataaatatatatttatatataaatacaaatacttatatatatttatatataagtattaatatataaatatatgtgtttatatattattatatataaataatatataaatatatgtgtttatatattattatatataaataatatataaatatatgtatttataatatttatctatttatctatctacagctattttacacatgtgacaatcagggttgcgatggaagacatcactacaagctggaaaatatgaacataattacatatgcagataacacagatccagagactatctgattgcaaggaacattatagatcacccctatataccataactttgaagctaatttgaaatgtggtttgtgaaagtattatacatttcctgcaatcccctccactgctgctagatggcagtaaaggaacgtgttagaaagtctggggaggggacctcatgatttatttaccgcgcagtcatgatttaccacgcaatcacggtttagtcttgttgtcctgtcataattaatagtatcctctttcacatacaaaagtgtctcaatttgaacattaaactatacggtcattgtagataatgacacaaatgatagcatctctgttgaaagtaaattgtttattaatgttgcagtaccttcatttctttgtttcggtttaatgaaatagattttttaaattatagaataaataaactcgaagctatagcattggtctgctttttgtcattttactatttaaatatatctcagccctacttacagtttgtattagcgatatgtggtgtatgaagcctcaacttaaaaactcagcttggtcttcgtagtgcttctgtcactgtctgcccagcacccactgcctctcaatgtgttccaacgtttcccaattcctacctgctaataaacctaccaggatatttccagacctattttctctgtgaagaaaaccaagcgacattgactttccctcattcatctactaatacataaatgtcaccacatgccagtgacaacggggtaaaataagtaataaaagtgaaataggataaaagaattgttatacatttattggctccggagaaatccaccctcttctctctagtctcctgcgcaccctgccaacaatgtcattggctgtaaaaatacctcatgttcatttaacactctacagtttactgagtaatttgttgtttcattttcatgctttaattatatgtttccaggttctctgagcttttgagctcctgctcttcccagatgggctttcataacaaggccagcccctttctctctccccttccgccagtgcccatcatttgaaccaaattttcttcctgtctctcttacttgattctttcccaacctgtgccttctgtttggtctcttaaaatatttccctattcagtgataactcccttaatgaaggcatctttattgactgccttggaaatcctcagaattatagaaacatctttcatgtccaccttggcatgttttatatgtttcacatatattttcataaataataaaaaagttatatattttccatacgtaataaaaatgtcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 71 - DNA, 252014 bp, Homo sapiens
tgccaaattccactttgtcattttcccattttttttttttttttacgtgtagggatcctgacttttaagatgaaaatagtgcagaattcctccctgtgcttccagatcattttctccctcctactttaaagcccagctgctttgtacatattactttataatattaccccttctcattgtacctaccttattaccttcagaaattttcttttttttaatccttctgcctgctactaatccagtcatcattcttaatactattcatcacatagacaatttattcactcgcgaggcttctaagtttctcgacttcctatatcctgagtctttttcccctctaatcattttcagacttgtttccatgattatagaccattaaggaacaacaaagatctttcaatatttctatttaaattgtcctgtcgttctaccactacctcccttctgtctatatcagtaactcctacaattcttctatttctctgacctctccagttcatagagcccataacttttatttttttaatttttttttggtctttctaggatgttatttattaaaaatagattctctgtccctaccctcacccctgctggcaaaatggcctttcccaacatcttttcctgcatggataacaggtcttgaggacgcagatgtgcatcctacctaaactacaggctcaggcttttctgggacagtgaggcagcagctctgccagagccaagggtggaacagcacaagacgacatcagcaaaccctggtgcacctaactgtgggctgctatggagtctgggatggactggagttcctcctgctccaggcctcgggagacaaaatccacaaagagagacccagtggcccagcagcagccccctgagagcccacaactttttaactcttacgctttaattcttacattcttttaattatattttaagatttaagactataatatcaaccccgattaaagccaactccccgtaggttcctatgaatggcagagttgggaggggcactaaaaaatccccgtgggaactcattcgatttatcttctgtagttgtcatagactcctcttaggttcctctacttctaatcttggcctccctcattctagccaccaacccagggtctactctcaatacagaagtcagagtgatcctttaggttagatgttgtcactcgtccactaaaccatacagtagattcccgtttcactcagagaaaagcctacagcctgcataggcctacgaggtcctcggtgatccccctccctgttgtatttcttgcctcctgtctgttcctctttcccttgcttattttttcacaacacagtggctttctggccattcctcgaatacacaaggcacacttctgccttagaacctttgctcaagctattccctttgcttggaacatccttctcccaagtatcccagtcaggcctgcaagaagcctgaattattctaccagtgacacaatcattttcctaaaaccacttttcaatttttatacattcaacaattctccattgttcaccagataaaaatgtcacctcgggagggcatttgaattttaaaacatttggaccatatcttatcttatttttgactactgagtaagataaatgttactttatcaagtgcacttcatacccttacaaaacagtcttacacaatttaatgcctgttcatacatttgttcttgcaatttctgctaccttcttcatattgttcaatacttctagtcactcaagacactactgaatgcttctttctctatgaagcaggaaatggttctatatactctattttcacagtggagtaaaatagatacacattttaggaacaaaacaaccatgcagattatagaaattaaactattttttacatactttcgaaggtgaggaagttcagaagctcaaatatggttaagatatgttttgcttctatttaagtccacattccccaccactttaaatcttccaagaaagatttccctcattcaaattaaaaacattttgatacaagactgggggcagggaagtgctgggtagagaagggcggggtccctggtgagggctccaccctcgggcctgtgcccacagacctaaatgaggacaggcgtttctgtttttgcactcaaaaagttgccttttggcccgccacgcctcccatcctgtgcccatataaacccgagaccttaagcggacacggacacaagaggctggacatctagaagagcagaagaatacagcagcagacaccggcagatcagcgatggcggaaggacacgaatgcgaggggagttcagccaggggaagtctgcgagagtcctgccactgggcagccaactgcaggggaaaaccaccgttccactccatccctcgacttctggctccccatctatctcactgagagccacttacaccacttaataaaagcttgcactcaacctttcagcccacatatgatctgattcttccagtacactggtcaagagctcaggctgtcacattggccccctgtccttgcaataagcagagggtctattgagttgactaatgcaacgagacggcagacggcatagctgaaagagtgcactgtaagtcctagacgctgccatcccttggagcccaaaagcactccccatggcctctgcacctgcccgtctgcatgctcccctaggggtttgagcactggggcaccagtgaagtgagccatccccctgtcacatgtcctgcgaggagaataagggaattctccggttttaacttaatctgtaaaagaccttgttaagaggatgaaaaagaagccacagcaatggataaaacatttgtaaactacatatccaacaaaggaatattatgactgtttcgagatttgcagaactgtctatttaacccatagactcatgagcaataataaattattattgctttaaccagtgagatttgagtgaggcttgttatacagcattactgtgcaggtgtcaattgatatactctatattgcaatatcgattcttaaattgtctaaccataatcctatagaccattactaattccaagcttgttctttttatgaagagtgtcgctcaactctgatgtctttgttctgtttaatattttgatttacacatgaacacagttcccagcagctttcaaacctccagaagcccttaacatttctgattctgaaaaatatcttttcttgttttcagcattttttattgttattttttattcttttgtatgggaaggtactcagtttaccatcctgaattagtaattctttaaacatttttgcaattccagtaattagagatattactgcattaggcattgaagataccatggtctttgcatttcctgcttgcatatcgagtcctatgaactatttctggtgtctctgagtcacttcccagtgtggtcattggcttttactgagtctgattcaccgacctttactgagcctcactcaccaacctttggtcattcttggacatagaagcacaaattcaacagtgttgtttcccaaaatatgtaatatgcagggaaaattacttttcatgtaaaatagacgtgtccttttagtattaccagtagattattctaattatagactagtaacatccaacagacttatttgggtttagtgacagacctattactgtgttcgctcctcagttcaaatacagagtgtgtattttgcatcgtgtggctgcaagttttggggttctccatcatatacttagctatacaatgccagctactcttgtctggatattttcccaaatcctggatgattacaaacttctccttcactggtgaaattttttttttttttttttttttgagatggagttttgctcttgttgtccaggctggagtgcaatggcacaatcttggctcactgcaacctctgcctcccaagttcaagtgattctcctgcctcagccttctgagtagctgggattacaggaatgtgccaccatgcccggctaatttttttttttttttttagtagagacagggtttctccatgtttgtcaggctggtctccaactcccgacctcaggtgatccacctgctttggcatcccaaagtgctgggattacaggcatgagccacagtgcctggccaatttttttttttttaatgaagggtcaaacctgatattaagtctttcagacagtaagaagataactattcagggtctacaagatggccaattagaagcagctgtggtccatggcactcagggagaggaatgaaacggggtgagtgaatttagcactgtcaattgagatattcaggttctcacactgggactgtctaggcaaacaactcaacccacagagaacaaagaaaagcagggggtgtggggcatgatggcccaccaggagcagcacagagccaaaggaacccccacccccagccaaaggaagcagtgagtgattgtgtgaccctgcccaggaaacgactcttctcccacagatctttgcaacacatggatcaggagatcccctcacaagcccacaacaacagggccttggatccagtacacagagctgcatggagtcttagcagagcagctgctcaggcacacacagagacccaggagttttacacattccagcctcaggatccccagcaaggcaggaaatctgtccacatataaccctaggaagggagctgaatccagggagccaagcagcatcattctgcaggccccacttccatagcacctcacaagttaagacgcactggcttggaattccagatagccaatagcaacagcctagaatctgcctgagataagtatgaattcctggggaaagggggtggccaccatctctgcagtccagtagacttagctgtttaagcctgccagctttggagaatacaaatggtctggatgaggaaaggttccccataatcagcacagctgccttgccagatcatggccagactgcttctttaagcaggaccttgatccatcccttctcagtgggcaggacctccctgtggaggcttcagccattctagccagtgttctacattgagagctctgatctctccctaggatggagctcctggcagggaggggcagcctccatctctgcagttcagtcaactcagtccttctagcctgttggctttgcagaatcccaaaatggtctggacgagaaagcctcctcataatgcagcacatttgctctaccaaaaagcagacagactgcttctttaatcaggcccctgatcctgttcatcccaactggatgagacctcccaacagggtctccagccacctcctacaggtgtgttctggccagcaacaggtcagtaccccccagggatggagcttccagaggaagaagctggctgccatctttgctgtttcacagccttcactgatgatacctccagtatgggaaaaaccgaggcaactaaggtctggagcggacttccagcaaaccacagcagccctacaataaagtggcctgactagtaaaggaaaaacaaaaaacagaaaacaacaagaacagtatcaatgaaaaggaccccacaaaatccaaggtcaaaggtcagcaagctcaaagattgaaggtagataagcccacaaaaatgagaaagaatcaacacaaaaatgttgaaaacttaaaaagcaagagtgccttttctcctccaaatgactgtaacacctctccagcaatggcacagaattgagctgaggctgaaatggctgaattgacagaagtagggttcagaaggtggtaataatgaactttgctgagctaaagaagcatgttgtaatccaatgcaaagaagctaagaatcatgataaaacaatacaggagctgacagccagaataaccagtttacagaggaacatgatcaacctaatggagctgaaaaatacaacacaagaccttcacaatgcaattacaagtatcagtgggagaacagaccaagtggaagaaggaatctcagagtctgaacactatctctcttaaataagaggggcagacaagaatagagggaaaagaatgaacaacaccccccagaaatttgggattatgtaaagagactgaacccatgactgactggggtacctaaaagagataaggataatggagtcaaattggaaaacatacttcaggatatgatccagaagatctttcccaacctagcaagacacaccaacattcaaattcaggaaatgcagagaaccccagtaagatactccatgagaagataaaccccaagacacataatcatcggattctccaaagttgaaatgaaaaaaaaatgttaagggcagccagagagaatggccaggccacctacaaacggaagcccatcagactaacagcagacctgtccgtggaaaccttataaagtacagtggttggaagctattctttaacattcttaaagaaaagaatctccaacccagaatttcatatctgaccaaactagcttcgtaagtgaagaagaaatacgatccttttcagacagcaaacacttaggaatttgtaccacaggactgccttgcaagagctcctctaggaagcactaaatatggaaagaagaaaaccattaccagccctacaaagcacactgaaatacacagaccagcaacactatgaagcaaccacataaacaagtctgtgaaataaccaggtagcatagtaatgacaggatccaacttacccataacaatactaacttttaagtgtaaacagggtaaatgccacaattaaaagatatagaattgcaagctgagtaaagaaccaagactcactgatatgctgtctttaggagacacatctcacatgcaaagacaaacataggctcaaaataaacggatggaagaaattttaccaaccaaatggaaaacagaaaaaagcaggggttgcaatcttagtttctgacaaaacagactttaaaccaacaaagaacaaaaaagacaaagaagggcattatataacggtaaagggttccattcaacaggaagagctagctatcctaaatatatatgcacccaatacaggagcacccagattcataaagcaagttcttagagacctacaaagagagacctggactcccacacaaaaatagtgggagactttaacaccccactgacagtattagaaacatcactgagaccaaaaactaacaaatatattcaggacccaaattcagctctggattaagtggaactgatagatatccatagaattcttcacctgaaaacatcagaatatacactcttctcatcatcatatggctgttgctcaaatcgatcacatatttggaagtaaaacattcctcagcaaatgcaaaacaactgaaatcatgacagtctctcagatcacagttcaatcaaattagaactcaagatcaagaaattcacttaaaccacacaactacatggaaattgaacaacctgctcctgaatgactcttggataaataacaaaattaaggcagaaatcaagaagttatttgaaactaatgagaacaaagagacaatgtaccagaatctctgggacagataaatcagtgttaagagggaaatgtattgcactaaaggcccactacaaacctctgctcaaagaaatgagagaagatacaaacaaatgaagaaacattccatgctcatgggtaggaagaatcaatattgtgaaaatagccatactgtacaaagtaacttatagattcaatgctattcccattaaactaccattgacgttcttcacagaattaggaaaaaaaactattttaaaattcatatggaaccaaaaaagagcctgaatagaaatagacaagacaatcataagcaaaaggaacaaagctagaggaatcatgctaccagacttcaaactatactttaaggctacaataaccaaaacagaatggtgctggtacaagagcagacacatagaccaatggaacagaatagagaactcagaaataatacgacacacctacaaccatctgatcttcaacaaacctgacaaaacaagcaatggggaaaggacttcctatttactaaatggtgttgggagagttggctagccaaatgcagaaaattgaaactggactccttccttacaccatatacaaaaattaactcaagatggattaaagacttacatgtaaaacccgaaactatgaacaccctagaagaaaacgtaggcaatctcatttaggacataggcacaggcaaagatttcatgacgaacatgccaaaagcaattgcaacaaaagcaaaaattgacaaatgcaatctaattaaactaaagagattctgcacagcaaaataaactatcatcagagtaaacagacaccctgtagaataggagaaattttttttgcaatctatctatctgaaaaaggtctaatatccagagtctgcaaggaacttaaacttacaacaaaaaaacaaccagacaaccccattaaaaagtaggcaaaggacgtgaacagacacttatcaaaagaagacatacatgtggccaagaaacatttaaaaaatagctcaacatcactgatcattagagaaatgtaaatcaaaccacaatgagattccatctcatgacagccagaatggctattataagagtcaaaaaacaatggatgctggtaaggttgcagagaaaaaggaacacttttacactgttgtgggagtgtaaatgagttaaaccactgtggaagacagtgtggtgattcctcaaaggcctagaggcagaaataccacttgacctagcaattctattatggggtacatacccaaaggaatataaatcattctattataaagatacatgcatgtgtatgttcattgcagcactgttcaccatagcaaagacatggaatcaacctaaatgcccatcagtgatagactggataaagaaaatgtggtgcatacaacatggaattatatgttggcataaaaagaaatgagatcaggctgggcacggtggctcatgcctgtaatcccagcactttgggaggccgaggtaggcagatcacgaggtcaggagattgagaccatcctagctaacacagtgaaaccccatctctactaaaaagacaaaaaattagctgagcgtggtggcgggcacctgtagtcccagctactcgggaggctgaggcaggagaatggcatgaacccgggaggcgaagcttgcagtgagctgagatcgtgccactgcactccagcctggatgacagagcaagactccatctcaaaaaataaataaataaataaataaataaataaataaatagaaatgagatcatgtcctttgcagggaaatggatagagttggaagccattacactcagcaaactaatgggaacagaaacccaaacactgcatgttctcacttataagagggagctgaatggtaagaacacatggacacatcacagggaacaagacacactagggcctgtcagaagacggttagtgggagggagagcatgaggcaagaaaaggtaatgaatgctggcttgatacctgggtgatgggatgatctgtgcagcaaaccaccatagcacatgtttacctatgtaacaaacctgcacttcctgcacaggtgccctggaacttaaaataaaagtcgaagagctccctctccctctccctctccctctccctccccctccccctccccctccccctgcctctgcctctgcctctgcctctctgtctcccctttccacggtctccctctgatgcggagctgaggctggactgtactgccgccatctcggctcactgcaacctccctgcctgattctcctgcctcagcctgccgagtgcctgggattgcaggtgcgcgccaccacgcctgactggtttttgtattttttggtggagacggggtttcgctgtgttggccgggctggtctccagctcctgaccgcgagtgatctgcctgcctcggcctcccgaggtgccgggattgcagacggagtcttgctcactcagtgctcaatcttgcccaggctggagtgcagtggtgtgatctcggctagctacaacctccaacctcccagccgcctaccttggcctcccaaagtgccgagattgcagcctctgcccggccgccaccccgtctgggaagtgaggagcgtctctgcctggccgcccatcctctgggatgtgagaagcccctctgcccggccgcccagtctgggaagtgaggagtgcctcttcccggccgtcatcccgtctaggaagtgaggagcgtctctgcccggccgcccatcgtctgagatgtggggagcgcctctgccccgccgccccgtctgggatgtggggagcgcctctgcccggccacgaccccgtctgggaagtgaggagccctctgcccagccgccaccccgtctggaggtgtacccaacagctgattgagaacgggccatgatgacgatggaggttttgtcgaatagaaaagggggaaatgtagggaaaagaaagagagatcagattgttactgtgtctgtgtggaaagaagtagacatgggagactccattttgttctgcactaagaaaaattcttctgccttgggatgctgttaatctataaccttacccccaaccccctgctctctgaaacatgtcttgtgtccactaagggttaaatggattaagggcggtgcaaaatgtgctttgttaaactgatgcttgaaggcagcatgctccttaagagtcatcaccaactccctaatctcaagtacccagggacacaaaaaccgcggaaggccgcagggtcctctgcctaggaaaccagagacccttgttcacatgtttatctgctgaccttccctccactattgtcctatgaccctgccaaatccccctctccgagaaacacccaagaatgatcaataaatactataaaaaaaataaaaaataaaaaaaataaagttgaatcaaagaaaaaaaaagtcgaagaaaaaaaaagaagataaccatttgaattgcctcatcaggtggcttgttatgggagaatgtatatttccaagactcttgaaattaaagagagtgagctatcataaacagtgagctcctagacagaaataatttagagtatgtgatagtaagcacacctgtcaaggctctctcctttgaagaaaatgtaatgaggaggactctgaaagaaattagagcatgtacacacaaagattcaaaatcaatcaacattattattacaaaagctgagagcagaattaaaagaatgcctgtgcttggaatacttgttatggagaattttaatttgctaagaaaatggatgagacactacagtattttgaagtgatacttccttctgatcatcagaacaggagcaaaggaagaatatttaaaattgaaagcttttatataattcttactgtgttttgggcatttcaagtgggttcattttccaagtagaaaatattcagcatctacttagaatgccttattttatggaagagtaaactgaagtagagagaagatacataattttcttcatgtcacatggctagtaaatggaggaaagagggattcaaacacaagaatttggggactggattccttttaaccatttataaactattataaccaaaattaaaaatataggttcattaaaatggaagaggaacaagacttccttaggaatagttctaacttcttagaagacatatttctcatatgaaagaaagaggaggttctcggccgggtgtggtggctcacacctgtaatctcagcactctgggaatttgaggcaggcggatcacttgagctcaggagtttgagacaagcctcggcaacatagtgagatcccatcactactaaaaataaaaaaaaattatctggggattggtggtgcatgcctgtggtcccagctactcgggaggctgaggtgggaaaatcacttgagcctagggggtaggggttgcagtgagccaagagcatgctactgtattccagcctaggtgacagagtgagacctcacccccaattaaaaaaaaaaagaaagaaaagaaaagaaagaaagaagaggctctcatatccaggaaagatcaattttagagggaagaggaaatgcactcagggtcaactgctctcaaggagttattagaagagatttattttggttgttactaaggcaggcaagataactggatgtaaagaatcttcatggaggaaaaacaaagatacaggatctcagaggggagactagataaactttacagaggaagacaggatttggggatttgttaaggaatgacttaaaatcaacactatataaagggttatatgcaatttggacatttttgagaagagatgccctgagacatcaattgaagactctcaaattatttgatgttcagctctagcctgtgcttgaaaggagcctgcttaattatttttaaaattatgagtcttaagaaagtgtaagaaagatggaacatattaaaggaaaagcaggcaaacaaaaaatgagaataccttttagatacaattgctcaaccaaggaaattaaagatattcaatatttatcttaatagtgcttgctttagaggatccagacattgttaattgcacatctctcaatagagaagaccacagagatcaaatctagaatattttgaaaagactagtgacaagtacaaacataaaatttaagaaggaatttaattctagtgaatattgctaatactacatgtgcttgagaaagaacaggacaaatttacaaagcctttcaaacttctagaaattcagcttaagctagaccaggcccagtggctcacgcttgtaatcccagcactttgggaggccgaggcgggtggattacctgaggtcaggagtgagagaccagcctggctaacatagtgaaacctcgtctctatgaaaaatacagaaattagcttggcatggtggcacaagcctgtaatcccagctacatgggaggctgaggcaggggaatcacttgaacccaggaggtataagttgcattgagccgagaccacgccactgcactccagcctaggcaacaaaagcaaaattccatctcaaaaagaaaaaaaaaaaaagtagtgagccaactctttattcagtaggggatcctgtccgctaaggaaaaggtaatggaagggcatattcgattcaggagaatgctagctagcccaataagctgcaaagctcagccccttctttaccagaatcaaagctcacatttccacttcagttgatctgacatgagtatttttctctcaggtgttttgaatcttaggtcagaaagagtggttacccctgcgcatgaccactgtgccaatgtaacacagcatatattactttgggtcttgacaaagggctcatttttagtgactgagtccttctggccaccaggagacacttcagtgccacaaccactcactgacactttagagttgctaagaggactgtcaggccatgggaaactaagaagaagctcaggcttggtacctgaatcatgagtcctacctgttgagcactgaaaaagcactggaaagagaagggaggacccaaaaacttctaaacctgtgcgaatgggctaagaccaatagtgaggttgggattttaggcaagtttgggatggttgtcagacaaagaagccactgatataccactagtacaatgcagttcgaattacaataaaaagttatagggggtttttttgggtcagaaagagaagaagtaaaagagcacacatgattcctatctccttttatcctccaaactaactctcactaacccacagaaatgttttcataggtggcacaaaggtaggctgcaacaattgtggccaatattatggtagagaaggaccctgccctgtaatgctcaacatattaatgttacgtgagagtgggacagggtcatctctgtgacagtatagtcacagaagcctcttcctgctcaaataagtggccttcattaaaagaaacacagaagaatcttgtttcataagctaatgccaatcactgagacagcaacggtttcaggaacatgagggaagctgttggaatgggctttcctttaaacctagcctggttccatcatgctgagtggtgggggctttaagtcagggcctgagaaggacagcctaactgtggtataagtcagagggctcctcattcctcataagccgacaaatacattaatatcatcagaaaaattaccagggcctgtggtgtcccaaattctgatttcattttccattgaagatcagagcacagaggaaggagatacctcactcatgtgctcttcttgttatatgctcacagtttctttgtttcaatgactctgtaccctggaagaggttagacctggatatgctaaaaaaaaatttttttaatccctatcctagaatattgtggccttgaatcaaagtgttttctatgtttgtgttttcatcttccttcctaagccctatatctaggttttgccttctccatccacaaatctcaggatgctatggagtctgaagacacctgattgcagaaagcacaagaccccccaccagcgcgcgcacatacacaaacaaatacaggaccagaaaggagtggttactgctgattctctaacattacaaaaatatcacggttgtaacttctcaccctgccagtcatatgtttctctgtcacttgacatactcccctctttggggtgttggaggaaaaaatctctgtgccaacagcagagacatggaactagtgtgtcacatccactctatgaacagaattcttactactatttataccctaaaaagcaggccattttctagagtttcaccccctcaccagaaagaatttatttgtgagtattggttgacttactataacaagagactcaagtgttaatcattaaaggaacctgttagtgctttcttagaagtaagaggaagatcacatttaactggagagtgccttattgtggttttcaaggaaggtcaaagctcttacttatcactgctcaatcttcacccgatgcccaaagaattaacataattttgaaccttaccctggagaagcgaaatgggaccttgtcctccagaaatgcagaagacactgtgctgtgggctgggggagtcacggagcacgagagtatccatctccagccctcactggaaataaaatctgcacagttctatctctttccagggcagccaccttgttctctgcatgaggagcatggaggtccagatgcttccaggagggatctggggcaaagctctaactaagcaacacattattttgattttgtgtgtctgggatataaggatggccggtaaggggaacaataaagttcttgagatttcacaagtaatttattgatgtccagaatttgaggtgctgatggtacacctaagtggcaatatgcaccaggcagatcaatatgtgactcgtcagagaaagcagaatgggtgatgtgatgtgcaatgccacagaagcactgcagccaggagaggtgacagctaatggggatgtttggagtctttgagtgaaccaaacacatcccagagtaattgtaatttatttcagtcaatcttctgtacagacttagcattcacctttggaggaaggtcctttgagcagggacagagatggtgatgtcactgacagtcccccttttactctgggtgagaggtctagaatcctcagctcctgtattcgtgcccacaagggcctcatctaggtgaaggctccacctgccccaccctgccatggccaccaggctcctctgctgtgtggttctttgtctcctgggagaaggtgagtccccacaaataaagcacctgcatttttggatattgccagttatgattccaattatgtttcttattctgtccccaaattctatctcttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggtcacagcgctgcagaatcacctgctccctgtgcagaaaccctggtgcttcctcttctcctccagtacccagcagctctcagcagcctttcttgctcctcccctagcacaggaagtacataggtttcgtgttccacatgtcctaggcaaggcaagaacaggtcataaggacacatcacgttaggaaacttttggtaggaagtcagtgggtgtgatggttcctgggattccacacatacttctcacaagggtgcctgagtccaagtttgagggcgagtgtcacagactggagctttcaagtgattgagtgagcttaaaactgtgcagccattgcacatggatgcttatctcctttgctgctttccgttatggcttctttgccatttcttttctcttctaccttaaaactttcaacatctttgatgacttccaacatcaatattggcttcccagttttttcacttgctcacttcaaatgatcatttccttcaccttgtgtcagatattcatttccactttctttttctagattccaatgacaaattatttgaattacccccaaatagtttcctcaagcatcccattgtctcatgcgggcttctcttttcatctctggtactacttctgcagcaattcttcaacccatcaggaccactaattgacttctcctgcaaatattgcaccatatatcatctcctcatgtactatattccttatctgacttagactatgtgttccaaggtgattgtgaaattttgcctatgtcttcagctcttttctttttctgtttcttacctggaaaataaaatggggcctactctgtgcccctttcaatgacacagagaacataaaatgtcccttacccttgtcaagcagtattataacgatacagtgtgtcttgaggtctgtaagtccctctatgcatataaaattatatacttttcttctattaaaataatttgttaccttttaatgagttcatcagtttcatctttcaattatagttatacttttgacaattatagaagtactaaaaaaagttatgcacccagaatgtatgattctatcacttttatgtgtgtgcgcacttcacttcatacgtacaaaaaagttaaaagaatgccgaataggcatatttatccattctcttgtaggaatgataaagatgaacttccaaggggaaaatattttcaaaataatccatggcacataaaattatttaagaaaaaataaatcaataaatatccctgttaagtttatatatagttttatatgcttgggtaaggaagaaaaaaagttgtgatatattttgctggttatttggagagataaaatatagaaagagcagaaagaacatgattagctttgtctttgtttaaaatttttgctttttaaatttgatacactatttaccatcaaaatttaaaacaacaccactgctataaaacaatatacagacaaactaaaaagaaaaaggaatttactatgtaaaaaaaaaaaaaaaagcgagagcttataggcagagtattaaggggaatttaaaattataaagacctgtaagttttcagagaggtataggcctcacagctggagctgggattttaatgtccatatgaaagagatgacagaaaacagccagaattacattgcttgccttaatcctggagcttcaaaatgctcccaggctttataaagtaaaagtattacaccccaaagacccagaaacataattggaaactggatgtttggtcaggcctttgggtgatagataaaaaggaaaagttaggagagaaaaattgaatcttcagactgtgtctcacatgtgtttggaatgaaatatactctgcatggaatgtacaccatatacccaaaaactgacaaaaaggtccataaccattaaaacccttggagaccctggcattaagagattcaatacggttctggagtaaacttctgcttccaaccaagatagattaacgggaattagatttaacttcttgcttgaaacagctaacaccccaacccccaccctgtccccctgcacacacacattcacacaacatgtggaataacggttgtcaagacattggaagtaggcaacagaagacagtgatctctgagagatggaaacaaccaagctgagaactatgactgtcttaatacctggagggagtttccaggccctgggccagaaagaggaatccaagcagagctgggtgatctcactgagctgagtcagagttggaaatacaagatcaaagcagctagatttcacatgacaggccattgaaaaggcgattgctgcacagagagaatcctggagaccttcctagggtctcccttaacccttcagctgtgctgtaagcagtacatgtgtgaggaaactccctaaggttggagaaagagccactcagcaagattagaggaaacaatgcctggagctcacaaagggctgagagtaatatatacatatattactctcatatatatatgtatatgtatatttttgcattgagaatgggaaacttaataattcatgggtcaatcagtagaggtttcagatgacttatgcctcagtataaaagcaaaataagcccttcactaaataagccacatttggctcctggcctatgtgggtgagacttcaaaatatcaaactgtttccgagtaacttaagtctcagagcaaaactaaagaatatttctaatgtacaagaatacctgttcggagatatcagtatgaatttattgtttttaaacgtatagatacaatggtaaagaaatgaatacatacctgtgtgaataatgggttggtatatatacatgtatttcatacttctgtccacttagaagaccactagtgcacagatgtttgttgccaaatattattctccaattaaaaaaaaatgaaaggtggttctaggaccctgaggtaaaaaatacaagaatgttgtaatgaggttttccaaaaaaaaaaaaaaaaaaaaaggatgggacatatctcaaaaggacagaggaatcaatctgaaagagcttccccaatgactaaggctggaacaatttgtaaaagaaaattcacaagttcacactgagaatgaaacgattaaataaataaataaataataaaaaatgtgagaaaggacaatctcttactgaagaattccaaattgcatatgtagaagaaacagagggaaatagaaaagtcactgtgacaacaccactgtgagtaactgccacacataaaacccaatagtgagtgctaaaattagtgggtgtagctaattttaattactaattaataactaataactttaataactaattaagaagaaatggatcatttgtacagtcacaaagtgtcatccccaaaatattaattaatatggtggttttaacatatgcccacacattcttttatactcatccctctagattcccctctcctggattcagtggcctgcctctaatgaacagacatgggaaatagaaaaatggtaaccgagtgatccaaagtaaataaactgacccataataagtcttgttaacctcatgtgcattctcttatgatgcaatgttgtgatgttatcatgtgactacatatctgtaatattcctcccccaaatctataattcctgtctaataatgagaaagcatcaaacaaatcccaaactgaaagagattctacaaaacacctgaccagtaatcttcaaatgtcaatatcgttaaaaacaaggaaagagctgtcacaaattgaaggacactaagaagatatgacacttaaatgcagtatgggatcctggattaggtgctagggcaggaaaaggtcattattagaaaaactggggaaatctgagtacagtctagcttagttgtgccaatgtcaaattcttagtttgtgtgatgttagcactagtgggtgttggatgaaggatataaagtcacttggtagtattgttatagctacaggacatcaattctccagctttgggtcacctgagtccctatcaagccaatttgtgaagctgctgttagttgtccttactccccagtcttggagctctcagttagacctagaatcaacctcttcttcctcttgacctctgcttcactgcatcctaaacgtggtgaggtggaggggtggtgagggaggctgagcagaagcccatcattcagaagcccatcactagagcttctctgatgattctctgagacaggggctccctctgtagtctcctttgtgcacaatcccaagcacgctgggccacacagactccaccaaagctagttttgtgaggaggcaaatattgaggctccattgtgaagagaatgtccatgtcagatttaagtacaaaagattaaagttgatgcattactattgcaggaaaatgatacctgtgagaatttccaaaagccagattttgtattgtgtggctggctgagtaatacccctccccacaaagacattcacatcctaatccctgggatctgcctctgttaccttagatggtgagagtagactttacagatgtgatgaagttaaggatctggagataaggagattattttggattagtctggtggccctcaatgcaattacatgtgtccttataagagatagccagggggagatcagacacaaatggagaagagaaggcaatgtgaccacaggagaagagattagagtgaggtgaccacaagccaaggagtgaggcagccactagaaacagaggcaaggaacgaatcctctcctatagcctccagggggaatacggtcctgatgacacctggattttggtccattgatactgattttggacttttccagaactgtgagaataaatctctgtcattgtaaaccagcaactttgtggtaatttttatagcagccactcaaaattaacacactccaatatgtccagttaacctgagactaggccaagaaactcatgttcttataatattttctgcaaaccttgctgtcatgtttttatctgacacccatctcaaactataatgaaagaaaataattttgagacttcaatgtccccctgtctggggtgtgccttccatagttcattggaaaagtctagtctcctttcaagattttattccagcagtacctcctcttgaaagaattttaggcattgttttctgttctcagtgcacatactaaaaagaaaaagacaaagactcatgtctacttgatgtttacatttttgcggggagggagagacagagataaacaaataagtaaggcatatagtgtattagcaggtgatacctgcaatgcagaaaaagaaaaggcagactaaggtgagggagaccaggactgtcagagtaaggagcgttgaaatgacaatacattgttcagagtagggcccaatgaggaagtgacctttgagcaatgatttcaaggagatgaaggaaagagacatgtaggtatctgggggaaaagaattccaggcagagggaggagccagtacaaataccctaaaaaaatattttaggaccaatgaggaggcccatatgactgaaaaattaaggaagggagtggtagactttatttccaagcggtaatggggcaggatggatcatttaagaccttgatggccttaagtgctttgttgttttgttttcttattccaaataaaactgggagctagtagatgatttggagatgagtgacatgatctagcatgttctagagggctgagtttgagagctagttcagaagtaggtgaaagcagggagatcagttaggaatctattgcagtaatccaggaaaaagatgatggtggccttgtcctgagggttagcaaagaaggtgatgaaaaaatggatggattctgagtgtattttcatgatagagccagttgaatttcctaatggattggctatagggtgggatagaaaaagaggatttgggaaccactctaaggttttcagctggaaggctgttggtggagtaaagttgaggataatctttcatgtttagagcatgctgtttgagagtggtggggggaaaatgttgattggagtgcattagagagataatgggaaaagagaatttggaggtaagtattgatcattagcaatagcaacaatagctaccgtagattaaaatgccccacagtctatggggatgtgatacatgagggaagacagggccagatgggatgaggtaggatccagacatcagactcaggagctacgagtggtatatataaggttaacacctagtcaaatgcataaacaggttgattttaattgatgtcagtttttctccattgccccctctagaggcaatcttcttcagagaaccctggctaggtcttctatgtttcatgtccgtagagggagctcctgagactgtggacattggctaatatgctgatgtcactggaggccacatcttacagggccaagagacagatttgctttcctttttctcatacttgtaagctccttcatctggaaatgtgatttacctgggtcctgccatggtttccaggcttctcagtttagtgtccctttgtctcctgggagcaagtgagtcttcaggtacttaaatatctgtgctgtaccctatcccagtctattcatgtcatgtattctgtttttgtctcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagccaagacacagtgcttcacagtcgtgcccttgctgtgcaaaaccatagccttctcctctcaactcacagctgcccaaaaggaaggctttccctgtgccttctcccccaaggaggggagataaagaaccagaattaactcatgaaatacaagagtattccaagaagatttgggtgaaaatacttgtggtttgggggatctctgaagttttttaaacagaactcaaactatgtgtttctcatatttatttttattttttaaagtgtatgttgcctggttataaagcagacttcttgcctatcttgctgctctgaaaggtttgtgactctgactgtgaggccacatctttatatcccttcttatagtaagagaaacaagtctttctgatgaaaataaaaatagtgaataaaaatgcatttactactggcttttaggatgctcaatgatgatgctagcaatggtggtagtggtgacgttggtaatggtggtgatgagtttaggttgcttttgtctagcatttataaatttccaaccactttaaaacaatctcattttagagtggaatagctaagtccattatcagaggttaatgctaattttctgttcacatagggtctgagtttttaatgtaaaaaatatagttagcactataaatagatatctgtcagccgatacagaacattttttaagatcacttccagttgctgcaataggaatatgtattcctattttttttcttttttctttttctttttttgagacgaagtcttgctctgtcgcccaggctggagtgcagtggcaaaatctcagctcactgcaacttctgcctcctgggtttaagcgattctcctgcctcagcctaccaagtagctgggattacaggtgcctgccaccatgcctggctatttgttgtatttttagtagagacgggatttcaccatgttggccaggctggtcttgaactcctgacctcaagtgatctgcctgcctcagcctcccaaagtgctgggtttacaggtgtgagctactgtgcccggcctttttttctttttgagacagggtttcattctgtcaccccggctggagtgccatggcagtgtgatcacggctcactacagcctcgacttcctgggctcaagcagtcctcctgcctcaggctccctagtagatgggactataggtgtgcatgaccacacccagctaatttttgcattttttgtagggacaggtctcactatgttgcccaggctggtcctaaacttcttggctcaagtgatcttcctgccttggcctcccaaaatgctgggattataggcataagacaccatgcctggcctggaatatgtaatttttaatgagacctaatggtataatacattctacctggttcaactgccttcttttaatatctggattccaatattctgctcatgtttcagccatgtttttgcaaacagtcctgaaattcactctaataataagtttcattttcccagtctgattgttatttagcacctcaaattattattgaactcatcctaatcctgattaggcaaatggatagtgagaaaatattacaagtgggcttggattttaattttttcaaacaatttaaaacccattttccttttctaatgatcaagatccaatttttagataatcagtactctctctttctatgtggacatgtaatatgaataggtatattgtttctgtcacaggcatcgcaaactcatatcttgcttgaaacttgtcgatgaactcctttagtatgacaagaacaaagagaaatagatttttaaagcatagccacatattggacatgagtttttcttcaaaatttcagctgcagaaccctaactggtgcctttccttttattgtgttatgtaatctaaggtcataataagtaactaaattattgatttatttttccactctgtaatctctccattatatttaaaaatagcagctatgaagcaaaacaagttcctcgttgggtacattgcctcaactccaaaatctaacaagcagaagtttaattcagtgctttgccatttcatactatagacaccgaatgtcctatcctataaggggcacacagtggttctctttatagttctgttagctcaagtggtatctttaggtacaatttttagaatttttttatttgttaatctttcttaaggtatgattgacagaaaaaaattgtaggtatttaaggtatacaaggcgatgttttgatatacatatacattgcaaaatgattaccacactcaagttaattaacatatccatcacctcacaaagttacctttgtatgtatatgtatggtgagaatgatctactctcagaaaatttcgagtgtacaataatcattaactatagtcaccatgctgtccattaggtctccagaactttcgagcacactccaaaacatcaacttttattctgattaagcctcaaatatgtcttcttgttgcaaatattagctatttttagattagctataaataatgaaaaatgctagcataaaagatggaaagaataaatgcagataagggctctaaggtctttacactttccaggaagtgataaaagctgcaatttaaattatacatgaagaagtcaaggatggcaactcctataaacagctgatacttcaaacctggaatgtctagtgctaagcagcccggacccctgcacccagcacacctctctttggcatgataggaggatgagggatccaggtcttctcctcccatgctgcccttggcctttatgttttgcctttcattagtaaggcttctcccttaattatcaccctatgacaggaaattcatcctaagcctggacacgtgagagatggtaactctgaagcagccccctgcggatgacaccaaatgaggccacacccagaacaaattgcaagaaataacaaggtatttcttacagaatccctaagagaacatgtctgtctgcatttaagtgtctacagtcataaatgcacagcatatgattggatcagatggaactgaaagactttcagtgcttcatggtgcccataactctcattgtcctgaagtggtgttggcagtggactcagcagggtgccgtgagatggtgaggctacacacatacgatcgtgaccaagctggctacacagatgggccaaactcaccctgtgatggtagacagagcttaccaatgggttccatgaatggacaatgggcatgctgctgtaataatcccttcgaccatgatggaagtcaggcaagacccaggccatgggaacattgaaaacagtcacctctagcctcaagtatttcctactgtttgccacactgtgcctacaaatatcatttatgatacagcttaaaattttcatgtttgtgaaaattattatcagccttatccaatctgatattttgaatgaaatcacattaaaaccatatattaatttaagaactggcatcttcataatagtgagtcttctacagtttcctagaccactaaaaaatcatggattgctatctcagacttgaaatgggtgatccttattcttctctcagtcagaacagtgaaaggtacagattcatggcagctagtccagcttctaaaagtcaacttctaattgtctactttaggacaaaaaagaaataatatccttaggaaggccaccatggaattcattctatctgaacaatccttacataatatcatttcttataatatgtcctcaacatcgtgctctgcatatatttctccaccatctctaaaaatcctcttagcccaggcctcctcaaactttaatgtgcatgtaaattatgaccttgttaaaatgcagattctaatccaatcagtcagggttggagctaaggttccctgtattttgaacaagagtccgtccaagtgatgccaaagctgccagtccatggaccacaatgagcagccaagctctagatgacacctacaataattacaggtgtaaggcccctcttctcaagtatcattttgcacagttcctggactaggtcagatacagaccctacttaccacatgtatctctgtattccaagtattacgtaatcatcagttttcctaaatctaggcaccaatattttaacatatattttcatggtataaatagaaattaattttctatagtaaatacactaatacctaatcacattcatgcatctttaatgtgagtagcaaaaagccaaggcactatcttaatggttattgagtgagactttagcaaatactatctttatggagaaacctctgggctgctttttaggatgtgagaaaagtgaggtaaagtgaggagaactggatgaacacgggacagagacagggacaggggcaaatatggggacacctgtctcaaggaagcagcaaatgatatagaaaataaatatctgttccatccctgttccagacaagcccatgtacctgccaagtaggaagctgtgtatcacattgcaacaaggaatgaccccggccctggtaaagtcaacagcaacagtcatcacaggccaatctgcctatcagggactggagactctctaaactcccacctctcaacccaggaatcagagcctgagacagacagatgcttcattcctgtatggggtggtattcctgccatgggtcctgggcttctccactggatggccctttgtctccttggaacaggtgagtactgggcagaaaggaaatctttgagcaaagctatcttgtcctcagtctgcacctttcattcacagcagtaacactgttctccttaactctgactccaaatttgtcttctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcagagacacagagctgcagtgcttcctgctctctgttcataaacctcattgtttcccagatccaggtgctttctctaggacttctccctcaccacctcttacaacaataggaagtgggttggtggctgtcaatatctgtagacagaagttgagcacaaaccaataaaaaccattgacagttatgccaagagtggaaaagtggttacacatgcctggcattcagttggtggtattttcccaggatcacatttagaacccatgctgtccttttcagaagacaaataagaactttttctttctttttttcattgttttaatctaagtcagaggcttagaaatataagaggtgatatgtgaagaattatggacacccaatgtctatgaagtccagtctctggcattcgatgaactcttataggatttaatcctcctggagaatccacatgtttttagcctagacctggagcaactacctcattaatgggagaatgaaagcacaagtatcccaagataaaaatttctcagaggtaaaaccacattggagagaaaaaaagagaagaccatacattaatctgctcatatctggagttggaggtactattgagatgagcaaatggaaaccataaatacataaagaaatgatattgaaaatagagtacatttggagatgaagatcatggagccatctgtatagaagagagtaataatgtcattaaggtgcataagagtgccagcaaatgtcaataagaaaaactacaggagggaagaagatgggagatcctgctccccttaacaaagataaataaaatgctgagtgagaaatattgcaacctcataaattgtcacatggaagtatgtatttataaattaccattataattaacatccctcaatgagaacgatattctgagaaaaaaaagcagaaaatatagttatatggctatctaaaaatgtaaaattttgcacattaaattaagataatctaggaaaaatatgacaagacctattacaaaagagcttttacaaattgtttgctttaatgatattaataacataatgatagctaacatttactaagcacatattacatgctagaccttaagtcttcttcacatatatttatagttcatgttagttttataacaacctcagaaagttaatactatagtaacctcactcatttatccatgaggaaactgaggcacagacaagtaactagccctttatcacgtatctcgtttgtggtggagccagtatcaaaatgtagacaatttactgctggagctcattctgtcttcggagtttacatggattctaagtcagaccttcagataggaaggtaaatggttataagccagaagatttccacactctcaccaacattgcactggcttttctttgggtcttggccagagggtgagcccttgtgactatgcttcactggttgactaggtttgagttgcaccgaggaccaacatagagaaagaaggtctttgggataaacctgggaggatgaagggtaaaaaatgcagaacttaaatcttgatcccaagggatcatttaaagatgaatgagtctcccttagaggatgagaaattaaacataaactctttaacttgcagagatgctgaagtgttttcctcaagtagtaaactttgaatcatggttatatgcatgggagggagcctatggggatggaacatggatgaaaaagtgacaggatgttcagggggcaggtgcgggcagaaaatcagctgcctccaagagtggtgagagaagctgtagagcatcctttatccagactggcacaacatgcagtccagaaggctgtgagatacgaggaaagggtcaccataaactgcaacctgactatgtcaaaaatgacacttggaatccgagagtgggtacgtgtggtggtatcacagatatacacccaccccatccccgcccaactgggagataagagacttacaggtttagcactttcaccactgggactagaaccctggatttagctagaggctggcttagaccttttcatggttcttctgtatgaaccacacaatttagaaccatactatttagagatgatcaatttatacgacctgcataaagcctgtctttccagaagaagctcaggttcaaaaaaaaaattgattcctctcttgtccttctcaatcttccctccttccttctttcctttcttcctgcctgcctgccttcctcattaaggatagacatgaactagtcacctgtatactctctgaggtatgctgttagtgctgacaacacattagttcaacctagaaaaactaaccctgttttattttatcttatctgagagtctgagacccctctttgatccttaaaaacttgccaatttcttgccaagcaaatatgtgcagggttttagagagccgtaggtaacagagacaaaatagaaacaacacacagaatttggagcaaagcctttagatctctaaagcttgaggccccactgctgctctaagcctgcctatggcaccaggttcctctgctatgagtccctctgcctcctgagggcagtgagtcctgggcgtagatagtctgtctgccttgggcactcacactgtagtctgtttccacaccttcctctggtagtccaatattcacccccattttcctctctagcccctgctcctacactctagtccacagactctgtggatatcctaatcacagagacagaaacagaggtgacactcagatgtgagtgatgaaacttacaatgctgtaaacaagactcaggacttagactgcctactgatgttcattcttgtgccatttgttcagcaaatatgtatttaggaactcctgtataacagaccttgtttccggttctggaaataaggtaataaacaaaccagagagacttgttttaaactcctggaatttataaaccaaagagatgtatgtgatgagaacagtacgactctggataagaaggaacctgttaccttaacactggccagtgcaaacccagtctggcagacatctgtgatcctctagacttgtaaggaatcctatagctgtatagctctttgcatttaagggcaaaactagacaagacagaacctcactctcatgaatccatgccctaagaaagagaagaaacttccctcataggaacattggtgcagtctcgcagttttcttatcaagtaggaaaattagaactgctaaaactttgtgccagaatttaagacaaataaattgcctggatcatgcattatttacaattatatttacaattatatacagatattttccctaatataaatctgttgatgaaccacttatgtggcatataaataggacttattaaaagttagatgcggtgctttagaagatatattaaaattattagagtctgacttaaatttttaatagtaatacaaaatataaagtaccacagccttgttcagaagaaacaggatttctgaaatccaccagaatagctttctaaaagccagtatcttatggcctttagtgggctgaaatacttataatgatggattggaaaaatggatgtttgagtgcataaggttcacgagtataagaaacaattggtacctcctaactatagattgtcagtttcagaggatgagaatgaatgtgccctcatcctcattttaattttgaaagacaatgcagatatccctactatagaatcattttttacatcaccacctatagagattaacaacatagatgtttccagctccctaagaggccaagaagtattaacccaaggtcagattcaggtaattgatcgtgactcacgaattttcagagatccacaatggttgtttttaaattttcagcagttatgtctttttctctggggagagggtattcaaagctcctcatgaggccattctggactacttttcccctcctgccccctgcccataaaacagtttacagaaataggtgtccagaccgtgggctgtagttcaccaactcctgctctagcctaattttgtctcattactagagcatggccattctgtggatgccagtgaagcctttctggggtttctctccaatgccttttaaagctttttcctacacagacacagtttactgtttagccaaaaaattaagataattcctccagacatctggagttcttgtgcagcttcctcctctctggtggtctttccttaaaaattctagctgcctcagcccccgctgattttgtaacctgtttccgcaactcaaaatttgccatgctctgttgctctcttccccattgtgtatgtgcagaaattgcccccatgttttggtgttttggcagaatcccagtcctgtgctgtctgctttccagtggctgaatacaattgtttcacatattctcttaatttgtgttacttgtatagagcaggatgctaaaggcaattggattctacaaagtgatcacgtcacagagaagccgccgacagaggtggagagagccacacagatagccagctgcctgtgctgcctgctcttcccctaattctgccatgagcccaatattcacctgcatcacaatcctttgtctgctggctgcaggtaagtccctgttctgcagttgtcagctccctgctctaagcctttcatccatgtcatcgaactccctcatgggctcagtctccaactcctgtctgctttctttacaggttctcctggtgaagaagtcgcccagactccaaaacatcttgtcagaggggaaggacagaaagcaaaattatattgtgccccaataaaaggacacagttaggttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatccacaatgttaaatattagctaatcttaggacacagactcatcacggactcagctcaggaagcaggtggtatactaggttggaaggaaataacagaaactagagctagcttaagccaaaggggaatgtattataaggctaaatgtatgtcccatagaaccacaaagcaagaacacaggaacttcccagaaataaactgcaatgaaaccttagaaccggtggtcgcgcctgtaatcccagagctttgggaggccgaggcgggaggatcacaaagtcaggagatcaagaccatcctgactaacacggtgaaaccctgtctctactaaaaaaaaaaaaaaaaaaatagccgggcctagtggtgggcgcctgtagtcccagctactcgctactcgggaggctgaggcaggagaatggcgtgaaccgggaggcggagcttgcagtgagccgagatcgtgccactgcactccagcctggacgacagaacgagactccatctcaaaaaaacaaaaaacaaaaaaaaaccttagaaccatggcatggctgattgacaactcattttttatataccttgtcggcctcattattctcttttattataagttgtcttttctgtttcttaggtcttacagtgattagaaaattgcagatttaggtgttagccctccagtcaattgagaccaacgtgactttctctcatgctagattacaaatccagggtgcagggggaaaaaatgtgatcctgctttactcaagaatgggctcgtggaaatccaagggaattgaattattttgaacaagatagtatctgggagtctgtccctctgaccttgtggaccaaggatttcaaggggtggaatccagtcagaacatccaataggcacccatcacaagtgagaagttggggataatacattttctggaatatagagaccttgggaaaagagaagagtttggagaggggatcaaaaccttattatttagaacaatatcagaccacgtaaagagtctggttaatctctctttaagaaattaaaccggccaggtgtggtggctcacggctataatcccagcactttggaaggccaaaagcaagcagatcacctgaggttgggagttcaagatcagcctgaccaacatgaagaaaccccatccctactaaaaatacaaaattagccaggtgtggtggcacatgcctgtaatcccagctacttaggaggctgaggctgaagaattgcttgaacctgggagggggaggttgtggtgagccgagagcgcaccactgcactctagcctgggcaacaagagcgaaactctgtctcaaaacaataaataaataaataaaatagaaggaataaaaagaaattaaacctagataacacaaaaagcatgttcattttaagtgtgacaacttcagatcctacaaattcactaattggcctctatggcactgaaggagaacagattaatgtactcttggtgtaaaacatattaatgcacagagaattaaaagatcttcaggtatatgattcaaattgtaatgaggggcaatgtactcaacatcaatattcctaatgaggcattatggtatcaactgtacctaggcaggagactacacttatgttgagcagttatagaattcaaaataactctgttaaaatttgataatccattctgttcacagatctggtcaccacctagcattcgctttgagagaagttcctttattctctccagttacatctgctcttatttcagtataagttgaacccagttgtcttacttccagaagtccaaagttacttcttttcttgggaaaaaaatttactgtgactcctggaaacagaagttctcactttatcatttttctgatctatttaatattataccttctcattttaagttccttttcccgctctccagaagtgagtgttccttagcgttctgttctcggtccccctcaagcccagtcttgctgttggtggtctacatctttgcttttgtcacagggaagtcactcctctagatgctatcttcagctttttcttgaaatatttccattctaccaaaactgttctcctaaagattaaaattacgtatttcccagaccaaaagacgcatgtgtgtttctttgcctgcttgatctctttgaagctcttgacaatactgaccatgccctaagtcctgagcattaatttttgctcagtttcatttacatcattttcaactagtttctcattttctctctattctttttgttttcaatgcagctcccagaaactaaatctatccatttaatattctttttcccaggaaaattcttctcattctatttaaagtgtaatattctagtttaatgggaaagttttttgttgttgttgtttagccttttaaaaatctctactgaaaaaattttggatatgaaaattagccaggcatggtggcgggagcctgtaatcccagctactcaggaggctgaggcaggagaatcgcttgaaacttggaggcggaggttgcagtgagctgagactgcaccactgtgctccagcctgggcaatggagagagactccatctcaaaaaaaaaaaaaaaaagaaaagaaaagaaaaaattgtgaaatgtggtctgagacaacttttctcagtgtcacctgaggcatgggttaaacaggtatattctaggacaggttcagaatttcagagtcgaaatttcttgttggtggactttaggaatacgtatcattgctcctgagtatttctgttagtgctgaagttctgccccaaggacttcataagattaataacatcgcaaatcttctgtagtgctttaaaattttgttcttcatttttttattctcactttcttctctttccttttccacttcctcttatgttttccttaatcttcaactttcctaagcacctgcaagtgggattggagccttgtttaacatcgtccatgtagcaaaataaggatgaggccaaatatttgaaccaaggatccccatctcctatggaaggtgccctgaggttgtgggtgttgctggggacatgatgtcatggccagatcctacatcatgcggccaagggaacccagaactttcactgctctttgctactgcacatcagaacccatcgctgggagtgtcttgcactgcctgacctcaccatggatatctggctcctctgctgggtgaccctgtgtctcttggcggcaggtgggtccaggtatacttaaacatttgcataaagatgtttttggctgggcgtggtggctcacagccgtaatcccacctttttgggaggttgaggtgagtagatcaccagaggtcaagagttcgagaccagcctggtcaacgtggtgaaaccccttctctaccaaaaaatacaaaaattagccaggcgtggtagtgtgctcctgtagtcccagctacttgggaggctgaggtgggaggatcacttgaatctgggaggtagaggctgcagtgagcagagatcacgacatttcactccagcctgggcaacacagagagaccctatctcaaaaaaaaaaaagatgttttctttgggcttcccttcaccttctatggcttccgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtggcacagcatggctgagtcagttccctccagggtgcaaaccctctggctgctcttctcccagttgaactccaagaaaacatttgaaaaagcctcttccttatcttcctaccccagaagaaagaagcgagttgattgttgtggctgcagctgctaccgggagagtacaagaccatgaattaaggtcttaaatggtcatgatgggcacactggacaatgggctcctgaaactacccaaatacaaaatgagacattctgtggatcaggaggaatccacatgtttagaaggaagggccccagaccaatttccaagttcagagaccagctatctgaggttgatattacttaccaaaacacaaaaacattcctactgattttatctcaaacacagttctcctgcaaactcttcccccaccaacgtaccccagcagaggcaatgacatgtacatttatggaacagcctgttgactactgcagatccatctcttcaataagaccaactttccctggaggtcagtgactaaaccaaaccgcaaggcagacggcaacacgaccctcttaggggatggatgccagagaaacactgactaaaatccccactcggggactgtcctagcacattcagttcctcacacagctgcacaggggagcgcgacgttttattctgttacttcaaacactcatctgttcctctctctctcttgcaggccctagactcacagacactggaattagagtcagaaaaattgctttctaatcccaaaactggttttgtttactccccttcagctgtgaaatcttggcaaatgctcttacttctctgggactcagtgtcctcctcttcaaaattagagacttgctccacttagtctctaagatctgatacaaatatgattatttgacttgctatttatttatttatacaaatattagaatatttatgtatacatttaacataaatatatttatatttaataaaaacataaaatttataacattttatataaatttatatcaataatatatatttattgatatacttatatcacataagagatatataaatatatgcaaatatattttatgtaaattttaatacaaatataaaaaatacattttctatataagtatatataaatacttatatataaatgtattttatacatttatatataaatatatatataaatatatatttatatataaatacaaatacttatatatatttatatataagtattaatatataaatatatgtgtttatatattattatatataaataatatataaatatatgtgtttatatattattatatataaataatatataaatatatgtatttataatatttatctatttatctatctacagctattttacacatgtgacaatcagggttgcgatggaagacatcactacaagctggaaaatatgaacataattacatatgcagataacacagatccagagactatctgattgcaaggaacattatagatcacccctatataccataactttgaagctaatttgaaatgtggtttgtgaaagtattatacatttcctgcaatcccctccactgctgctagatggcagtaaaggaacgtgttagaaagtctggggaggggacctcatgatttatttaccgcgcagtcatgatttaccacgcaatcacggtttagtcttgttgtcctgtcataattaatagtatcctctttcacatacaaaagtgtctcaatttgaacattaaactatacggtcattgtagataatgacacaaatgatagcatctctgttgaaagtaaattgtttattaatgttgcagtaccttcatttctttgtttcggtttaatgaaatagattttttaaattatagaataaataaactcgaagctatagcattggtctgctttttgtcattttactatttaaatatatctcagccctacttacagtttgtattagcgatatgtggtgtatgaagcctcaacttaaaaactcagcttggtcttcgtagtgcttctgtcactgtctgcccagcacccactgcctctcaatgtgttccaacgtttcccaattcctacctgctaataaacctaccaggatatttccagacctattttctctgtgaagaaaaccaagcgacattgactttccctcattcatctactaatacataaatgtcaccacatgccagtgacaacggggtaaaataagtaataaaagtgaaataggataaaagaattgttatacatttattggctccggagaaatccaccctcttctctctagtctcctgcgcaccctgccaacaatgtcattggctgtaaaaatacctcatgttcatttaacactctacagtttactgagtaatttgttgtttcattttcatgctttaattatatgtttccaggttctctgagcttttgagctcctgctcttcccagatgggctttcataacaaggccagcccctttctctctccccttccgccagtgcccatcatttgaaccaaattttcttcctgtctctcttacttgattctttcccaacctgtgccttctgtttggtctcttaaaatatttccctattcagtgataactcccttaatgaaggcatctttattgactgccttggaaatcctcagaattatagaaacatctttcatgtccaccttggcatgttttatatgtttcacatatattttcataaataataaaaaagttatatattttccatacgtaataaaaatgtcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 72 - DNA, 1244 bp, Homo sapiens
tcaatcccaaatttgtgatgctgtgccaatttgtaataaggagtttaggaaaaactctctaagcagggagggacaggctctgccatcacaagtcagtggagttacacagagagccataactttacactttaggatttatccaaatgttaaaagaaagtaaacatttcagcttggtggcccatgtgatctctgtcacaactattcagttctgccgttgtggcctcaaaacagccattgatgcattgtaaataaatgcacgtggctgtgtgccaagaaaacattatttacaaaaataggctttaggctggattttccatgcctgctgtgtctgaacattttctcttctccagtgataaccagtcgttctgctcagtggtgggggtggtatttgccgagccagaatgtgtgtgctgttttaggaatccgtcacctttgaggatgtggccgtggagttcatccaggagtgggcattgctggacagcgcacggaggagcctgtgcaaatacaggatgcttgaccagtgcaggaccctggcctccaggggtaaggctggcgtcacctggctccttcctgtacgcaggcactaaatgcttcttaagcgcctgccatgtgaagaagacagacgtggcttaggctttgtggcacttagcgtccacaggatgacaaagcttcatctgttgcattgacttctttccctctgtagtaaggccctgtttgggtctccttgaatttggccccaggcttctgaggtgagacagcctcagccccttggggcagaggggagggtgtttgtgggttgggtcctgagttcattagctattgggcaagatccctttgctacccatcacacttgctcagcccagagaatctgaagcccatattgaagctgaaggagagtttgagttgagaaacaagagtttgttttcccctgcaagccctctctctctcagtgcctgtgtctttcttcatgtgcaggaactccaccatgcaaacccagttgtgtctcccagctggggcaaagagcagagccaaaggcaacagaacgagggattctccgtgccacaggtgttggtgagtaccaggcaggctgtggatcccccgacccccctggttgggtggtgtgccttgggaagtgtcaagagcattttcaaaggccctttgttctgaggggacatcgaaggccattcggagtgaggtttctcaagttcctttagcttctcttctattttcactttctagccctc

SEQ ID NO: 73 - DNA, 2512 bp, Homo sapiens
caacatgttgcttatggagataaatgtcctgtaagggttttgattgtgaccactctgctggagatcccccaaaatgctctgcttccgtcctcaccccttcttttacctcagtgtctcctttattgcagggagaacaccgactgagacctcaaaccctggctccagtgtcatggtgaggaaactgggggctcctgtggctgaaggggtggatatgtaggataactatgtcctctgggccctgtcttctctctcgccacttccgtccccaactgaggaagaaagggaagggtgagtgaggagcatcctcatccctgccctaggggacctagggacttccttctgtgcctgacctctagaggtggcatggaagaagagtcccacagcagaccctggggctctgagcggagctcctccagggccatccttgtcatccctggtgagacctattgaaaacacatgtggccatagaaatataaattcagcttaaattaattaagattcagtacatttagccgggcatggttgtgtgtgcctggaatcgcagctacttgggaggttgaggtgggaggatagcttgagcccaggagattgaggctgcattgagctaggattgtgaccctgcactccagcctaagctacagagtaaaaccttgtctctaaaaaaaaaaaaaaaaaaaaaaaaattaaaaagtttaagcgctcagtttctcagtcgccccagtcacattgcccaagtgctcaacagccacatgtgctggtagcccctttctggaaagcacaggcatggaacattcccatcatcagagagtgatgtctgttggacagcactgctctgaagaattctgcaattaaaaggattctcagatgaggccgggcgtggtggctcatgcctgtaatcccagcactttgggaggccgaggcgggcagatcacttgaggctgggagttcaagaccagcctggccaacatggtgaaactctgtctctactaaaaatacaaaaagttagctgggtgtgtggcacgtgcctgtaatcccagctacttgggaggctgaggtaggaaaatcgcttgaacccaggaggtgaaggttgcagtgagccgagatggcgccactgcactccagcctggacgacagagcaagactgtctcaaaaaaaaaaaagaaaaaaagaaaaagactctcagatgcaatggaagtcctactttcacaagtatataattaaggacgtaagtcttgggggatcccagggacttcacagaaattaagctttcaatcccaaatttgtgatgctgtgccaatttgtaataaggagtttaggaaaaactctctaagcagggagggacaggctctgccatcacaagtcagtggagttacacagagagccataactttacactttaggatttatccaaatgttaaaagaaagtaaacatttcagcttggtggcccatgtgatctctgtcacaactattcagttctgccgttgtggcctcaaaacagccattgatgcattgtaaataaatgcacgtggctgtgtgccaagaaaacattatttacaaaaataggctttaggctggattttccatgcctgctgtgtctgaacattttctcttctccagtgataaccagtcgttctgctcagtggtgggggtggtatttgccgagccagaatgtgtgtgctgttttaggaatccgtcacctttgaggatgtggccgtggagttcatccaggagtgggcattgctggacagcgcacggaggagcctgtgcaaatacaggatgcttgaccagtgcaggaccctggcctccaggggtaaggctggcgtcacctggctccttcctgtacgcaggcactaaatgcttcttaagcgcctgccatgtgaagaagacagacgtggcttaggctttgtggcacttagcgtccacaggatgacaaagcttcatctgttgcattgacttctttccctctgtagtaaggccctgtttgggtctccttgaatttggccccaggcttctgaggtgagacagcctcagccccttggggcagaggggagggtgtttgtgggttgggtcctgagttcattagctattgggcaagatccctttgctacccatcacacttgctcagcccagagaatctgaagcccatattgaagctgaaggagagtttgagttgagaaacaagagtttgttttcccctgcaagccctctctctctcagtgcctgtgtctttcttcatgtgcaggaactccaccatgcaaacccagttgtgtctcccagctggggcaaagagcagagccaaaggcaacagaacgagggattctccgtgccacaggtgttggtgagtaccaggcaggctgtggatcccccgacccccctggttgggtggtgtgccttgggaagtgtcaagagcattttcaaaggccctttgttctgaggggacatcgaaggccattcggagtgaggtttctcaagttcctttagcttctcttctattttcactttctagccctc

SEQ ID NO: 74 - DNA, 1262 bp, Homo sapiens
aacaatcctgagcatacagttgcttcataaataggcatcagatgagttattaatctgtgataatagttttttcccctcaaatcagatggtttgttatgttaattctgagtccagaaacacaaattcttaaaaggttgatttatttgattttttaaaagtatgtgttattgtgcttattttaaaggctaataaaactgttcttctaaactgttgctattctcctagtaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacaggtaaccctgactctcactgctgacagtgtgtttgcttagtgagacccactgcttgccttcccgccaacttctgagcacctccacaggggaagccctgtgatttgtggtgtctgcattctggaaggtcagagagaaatgcaagaccactgcttgactttcttgcatataagggctgcacagacaggttggtggctgcagagaggaatctgcacttgccttccgaacagttctgcccaagcctaaaagagagagaaatagaaggaacgtttatgaatatcataggtggaaaaatgaggtcaggataattagaatcttctctgtcttccaaagataatatagctggctgctctgctgctgtcacagtcatttcagggttcacctccagtgtgccgtgggtatgaacttaattaagtactaagaggtaatgaattggaattttttgcttagtactatttttcttcagagcatgcaaacccataaatcctgcaaagctgtcaaaaggaaatacctactctgctagtgatgtggaggaaaacagatgccacttattcaataaactaatatccacacagaagaaaaatgttgactagatacctcagagtcaaagttggtttgaaagtttgtcaataaagaattttatggccatgaactgaggatgaaatttagctgaacaagtgaattaaaatttcaggta

SEQ ID NO: 75 - DNA, 9066 bp, Homo sapiens
gagagagataccttccgtttcaaggaatatgcagtttggatgtctgaaaaagatttatggcagagatgctggatggaaaacaaacacacagtttgagagggtcctttttatttttattttattttatttatttatttttttgagatggagtcttgctgtgtcacccaggctggagtgcaatggtgcaatctccgctcactgcaacctctgcctcctggtttcaagtgattctcctgcctcagcctctggagtagctgggactacaggcacctgccaccacccctggataatttttgtatttttagtggagacgaggttttcaccacgttgaccaggctggtctcgaactcctgacctcatatgatcctcccgccttggcttcccaaagttctgggattacaggcatgagccactgcgcctggccaagagggtgtctgggaggccgaagcgggaggatcatgaggtcaggagatcgagaccatcctggctaacatggtgaaaccctgtctgtactaaaaatacaaaaaattagccaggcatggtggtgggcacctgtagttccagctactcaggaggctgaggcaggagaatggcgtgaatctgggaggcggagcttgcagtgagctgagatcgcaccactgtactccagcctgggcaacagagcaagactccgtctcaaaaaaaaaaaaaaaaagttaaacacatgtctaacctatgacccagaaatttcagttctgggtatttatgcacaagaaatgaaaaggtatctatctgcataaaaagacttgaataagatttttcataatagttgtattcaccataactaaaaatataagccacctaaacatctattatgtgaaagagtacccatggaatgtatagcttggatactactcagcaataagagaagtatgaacaagaggtagaatgcagttcagagacaaacacatgaaaaacacaaaagagaggcaaaaaaaggtggcagtggaaggaggaattctgacacatgcttaaccggagttccagaagaagataagacagtgaaggggacatgtgatagtcaaaggcaggccccaatcctcagatcaggaaccataacaattctcagagagaataaatgaacagaaatccatatttagatccatcagagtgaaactgcagaacaccaaagaccacaagaagattttaaaagcagcaagtacaagagagattaccctcagaacaccaacaacagattgacagttgacttcacaacagcaataatggaagacacagagctggatacacaaaggaaattgactacaatctagaatccaaaagattcttgaaggatgagggcaaaataaagccattttcggatacacaaaagctgagagcagctattgcaaagagactctcactaaagggcctccacaccaatgcacttcaggaagaaggaaagaggtttcggacggaaggtctgtgtgcagagggaatggctgtctcagaggcgactcaaactcagtatgtccagaaaggactcacaatctgctctcccagcccagcgcctcctgggactttggcctctgtggatgatgaccacagtcacttgggccagaaacatagacatcatcttgataccccttctccctcacctcccccatatccagtcacctccagtcctgtcatctttgcctcctaatctctttcatctctgcccttttctctccatctccatggccacccagctgccactgcattttgctcaccacctgcaattggccttccagcccctgaacccctctgatctgctcagcccgctctccacaccgaacccgaggctctctctttgaatggcaatctgatagtctcccccctgtttaaaacatgaaatggtatcctactaccctggggataaaaacaagacaaaaacgtttaagaggttagagaggtcttcatgattcagtccccacccacctctcagactcacctcccgccccagcctctctggactcttttggcccctcatgggtgccatcattttgcccacataggctcttgtctgtgctgttttcactatagagtgggtccttcccttctttctttgtctaattcatgacactcatcgtttagtgcatttggcacttcctccaggaagcctgccttgacctccctgactatatcagctctcccccattaaatgttcccctcgtgccatggtcccctcatctgtgacattgatcacatgagcaatttcacatttattcatgtagttagttatagtctggatcctcctttggattttaagttcctataggtaaaagccttcctctcctttggccaccgagatatctccaggactaccatggacatgcagtaaacattcaccagttgttgaatttatgagtgggtgagtggtgcctgccaccctagaatttcccttatttgaaattctagaataagcagattcacttctttttcacatccatgtgaatttttgttcttgtataaatgaatagtaagtaagagccataagaaataattggagaaagaaggaattgggaattgggaagagaaaagagagaaaaacaatagaggcagagcaggggctttttgcagtgatgcttggggagaagaaggaagccgaagggacagcaagtgggtagatggcaggtgactggccccaggttatccagagcagagctgagaccacccagtcctaaggggaaggggctgggaaggaagccactcagctctgccaagcagattaaatacagatcaacaagagcctttcccattttgaaaatgtacattgctctgtgttgctgggactgcagtgagacccaggaggcaggaataaacaattctgagtcataaaatcattaaggcatcaaacatttggatcgatgagcagacacaaaagaatatgcttcctatacacatgttaaaagcctaactcttgacaaggatctcaccgaatctcttgggcagaaggattctgtaatggaaagtaattgcacgccactcatctttgttaatttaagatgagtaaagggttattgattcactctttgtttcatgagctgttttcatattgaatttcagtgaacaaaaatatttttaataaggatttcatgggcttatttggcatctttctctcccaagctgcagagctatagatccaactgccagctggacaaacccaactcatctccagccatggcccctcctgatgtgagcctatctcaggttctggtaccacaatccacccagtgccaagccagacactcacgtatcaccctggatgccctccgcagcccctcacccatccaacagatgccccgtccctgtgcctgctaactccctcccacctctccagctcaaggcctccctcccacgtgctggatcctgcctgttcagacctgtcctgtctcctggtggccaaactggcctccccagtcagtccctgctgcagaaagtggtttctttctttctttctttctttctttcttttttttttttttttgagatgaagtcttattccatcgaccagggcctggagtgcaatggtgcaatcttggctcactgcaacctctgcctcctgggttcaagcaattcttttgcctcattcccctgagtagctgggattatagacatgcaccaccacgcatggctaatttttgtatttttagtaggggtggggtttcaccatgttggccaggctggtcttgaactcctgacctcaagtgatccactgatcttggcctcccaaagtgctgggattacccctgtgagccaccgcacccagcctggaaagtagtttctatagtacaaagccgggggtgctgctcccctgccccacacacctcagcacctccatgttgcttcctgtggagtagacactattgttttgtctgcccagtctcttcttttcttgtgggaatatgcttctggaatatttgtctggaaaaccctctccttttgataactgtctttgcctccctgggactgcagctgacgtgcttgcatgtgtgtgtgtgtgtgcgcgcgcgtgtgtgtgcgtgcatgcgtgtgtgtgtgtgtgtgtgtgttgggatcggcttccaaatcttcctactgggggaatgcccattatccattagatgccactcagtgggaagtggtgccccacccgtccgtggagacctaaggggcttaatagatcctccctgcatagccagagacggatacaatctgggctcagtgaatcggtgctttgactgctcacagcgtagctgagagcttactcccagaatggcgaaggtggcaaagagtccccatagctggtgttgttggctgccatcaccccttttatccaggggcacagctgaaatctgtgccactcggctctgctgggcaggtgggataaatctgccccagcctctgtgctgtccccatccctgctcctgctgcccagcagcctggagtccttctccagacttcctgtaactctctccccaagccaatgccctccctcgggtgaacaagggcccctccttgtgacccatggtgcctggcttgccttggccccagccctcctccctgtgccgaaatcatctctctgtggacctttctccctcatggactcccacctccttgtgggcaggaaccagcccttggccatgttccggctccctagtgcccagtatgtgtttggtgaatttgggggcatgggttggatgatcttggttcagttaccaaatctttctttcctgtccaatcagtcttccaggatctcaaccagttctctcactgcagagtctggagaagcccagccctcattgtgaagggagagccaccgtggtgctcacagcaagacacccagagtcccttccagacagggacacccctggagcgaccctgtttcagaatgaagttatctgggtgggaactcaccaagaatgcacagagggcgctgggctccaagcttcagcatatcctttcactggactccacacaggcctgcggagcaggtggacccaccattctcagaccccccagggccccatagacagcagatctgctgctttcaatcacacccactgcctctcatgccggagtgggggaaatggaacccgcaaagcctgcaggccagggagggtgggaaactggggtgatgtgagcccacagggtggagcactgtggactgaatgcctgtgtcccctgggttcatatgttgaacccctaactcccaatgtgatggtgtcaggaggtggagcctttgggaggtggttaggccgtgagggtggagacccatgctggggttggtgcccttatggttctcccatgtgaggacacagagggcagccatctacaagccaagaagagaggcctcaccagacaccaaacctgccggcaccttgctgtgagatttccagcccccagagctgtgagaaataaatttctgttgtttaaggcactcaatattttgttacagtagcccaagctgactgagcagatattcatatggaaagtgaattttgatctctacttcatgccgtacataaaagccaattccagattgactgtagatacagattggcaaagcaaaacagtacagtttctagaaagaaacaggaaaatatctgcatgaggtggtcaaatatttcctagagaggacacaaaaagcactaactacaaaataaacaatgataaattggactgcattaaaattaagaacatctgtttaacaaaagaccccacgaagagcgtgagaagccagagtgcagagtgggaggagaaatctgacctgagatgggaaattagaatatgaagaactccttcaagtcagcaagaagacaggcaagccgagaggaggacgggcaaacgacctcaacagacactttacagaagagatatccaggccaggtgcagtggctcatgcctgtaatcccagcactttgggaggctgaggccggtggatcacctgggatcaggagtccaagatcagcctggccaacatgtcgaagtgccatctctactaaaaatacaaaaatttgctgggcttggtggtgtgcacttgtaatcccagctacatgggaagcggaggtgggagaatttcttgaacccgggaggcagactttgcagtgagctgagatcgtgccactgcactccagcctgcgggacagagtgagactccatatcaaaaaaaaaaaaaaagatatacacataagagaatattcaactttattaatcattggggaaatacaaattaaagccaaagggagacaacactccttacccctaggaatggctaaagttaaaaagatgggaatacccatgtcaggaaggatttgaaacaactgcaactctcatatgctgcaggtgggaagtaggaggcaggcctccactccagaggaggggctcacatgacacacaccaaattgaggactagctagaacagggatggctggaagcagctttccataagacacacccaccagtgtgccacgtcagtttaccattgccatggcgacacccagaagttaatgcccctttccatggcaatgacctgatgacccagaagctaccatccttttcctagaaatttctgaataatccacctcttaatttgcatgtaattaaaagtggcaataaatctgactacacactacctctgagctgctgctccgggcacactgcctatggggtagccctgccccacagggagcagcccttctgctgctgctgctgctgtttacggctgcttcaataaaaactgctaactccattggctcgcccttaccttctttcttgggtgaagccacaaaccctcctggggtaagccccaattttggggctcgcctggcctgcatcagtgggagtttttggcagtataagttaagctggatacaagtatcctccatggtgtgacttctaggcagcatataatcaattaaaatgcaaacataagttaccaaaagacatgtacaagaatgttcctagcagcctattcataacagccagaactgggagtactccggatgttaccaagaggagaatgggtaagtcaattgtggtatattcatgtaatggaatactccacaatgagaacaaatgaaccacaccttcatgcaacagtgtggatggcgattcgagttcaaaaacaggcaccattagttggtcatattagaaataaggctgtgctggccaggcatggtggctcacaactgtaatcccagcactttggaaggccgaggcaggtggatcacttgagtccaagagtttgagatcagtctgggcaacgtgaggaaaccctgtgtctacaaaaatacaaaaattagctaggcgtagtggcacatgcctgtagtcccagggagggaggctgaggtgggaggattgcttgagcccgggaggtggaggttgcagtgagcaaagattgtgtcactgcgctccagcctgggtgacagagtaagaacctgtcagaaaagaaagaaagagaagaaagaaagaaaagaaagaaaagaaggaaggaaggagggaaggaaggaaggaaaagaaaataaaaggaaaaaagaaagaaagaaaagaaaagaaaggaaggaaagagagggaaggaaggaaggaaagaagggagggaggggagggaaagggagggaggggaggggagggaaaagataagaaaggaaaagaaaagacataaggttgtgttggccgggcgcagtggctcacgtctgtaatcccagcactttgggaggctgaggtgggtggattgcttgagcccaggagtttgagaccagcctgggcaacatagtggggccttgtctctacaaaaaataaaaaaattagccaggtgtggtggcaggtgcctgtagtcccagcttattcgagaggctgaggtgggaggattgcttgaacctgaaacgtggaggttgcagggagctgagatcgtgccactgcactccagcctgggggacagagtgagaccctgtctcaaaaaaaaaaaaaaaaaaaagaaggctgtgtttacccttggaaggtcacgagggagggaggtttctaggggttccagcaatgttctattttttgatccaagtactggttctcaagcatgctcactttgtgaaaatttactgggtggaactgtggggaaaagagagagatcagactgttactgtgtctgtgtagaaagaagtagacataagagactccattttgttcttgtggcccaggctgaagtgcaatggcgcgatctcggctcactgcaacctccacctcccaggttcaagcaattctcctgcctcagccttcccaagtagctgggattacaggcatgcgccaccacgcccggctaattttgtatttttagtagagatggggtttctccgtgtgggtcaggctggtctcaaactcccgatctcaggtgatctgcccacctcggcctcccaaagtcctgggattacaggtgtgagctaccgcgcccggctaatttttttgtattggttgcagtgagccgagatcgcgccattgcactccagcctgggcaacaagaacaaaatggagtctcttatgtctacttctttctacacagacacagtagcaatctgatctctctttcctttccccacatggaactcaatttgtgtttttcaaacaaagatgttacaccttgcagtttgtactctgttaaatgcttttaaattttacacacaaaactccaagggatcacatgagtgacagaattgaaacactcacactgttttttgggtttggaaaccacccccgctccatcccacacaggggcttgcggatccagctctgtgcccggcccccctcttgcacacatccggaaagcaggtgggcagggaaagcaggtgggtgtggtctggaggagagaggggcacaggctgagaatggtgggggggtccctgggccctgcatggtgagaggaggcccagggcagggccttctaaaatccaaggccccgacagcaggatccctggctgcctaggtctaggggcaggaccgaaggtcatcgaggacgggtggcctgggattgctggcaccaattcctgttacctcgagggtggggcctgccaaaaggaggga

SEQ ID NO: 76 - DNA, 10901 bp, Homo sapiens
gtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgag

SEQ ID NO: 77 - DNA, 11411 bp, Homo sapiens
gagagagataccttccgtttcaaggaatatgcagtttggatgtctgaaaaagatttatggcagagatgctggatggaaaacaaacacacagtttgagagggtcctttttatttttattttattttatttatttatttttttgagatggagtcttgctgtgtcacccaggctggagtgcaatggtgcaatctccgctcactgcaacctctgcctcctggtttcaagtgattctcctgcctcagcctctggagtagctgggactacaggcacctgccaccacccctggataatttttgtatttttagtggagacgaggttttcaccacgttgaccaggctggtctcgaactcctgacctcatatgatcctcccgccttggcttcccaaagttctgggattacaggcatgagccactgcgcctggccaagagggtgtctgggaggccgaagcgggaggatcatgaggtcaggagatcgagaccatcctggctaacatggtgaaaccctgtctgtactaaaaatacaaaaaattagccaggcatggtggtgggcacctgtagttccagctactcaggaggctgaggcaggagaatggcgtgaatctgggaggcggagcttgcagtgagctgagatcgcaccactgtactccagcctgggcaacagagcaagactccgtctcaaaaaaaaaaaaaaaaagttaaacacatgtctaacctatgacccagaaatttcagttctgggtatttatgcacaagaaatgaaaaggtatctatctgcataaaaagacttgaataagatttttcataatagttgtattcaccataactaaaaatataagccacctaaacatctattatgtgaaagagtacccatggaatgtatagcttggatactactcagcaataagagaagtatgaacaagaggtagaatgcagttcagagacaaacacatgaaaaacacaaaagagaggcaaaaaaaggtggcagtggaaggaggaattctgacacatgcttaaccggagttccagaagaagataagacagtgaaggggacatgtgatagtcaaaggcaggccccaatcctcagatcaggaaccataacaattctcagagagaataaatgaacagaaatccatatttagatccatcagagtgaaactgcagaacaccaaagaccacaagaagattttaaaagcagcaagtacaagagagattaccctcagaacaccaacaacagattgacagttgacttcacaacagcaataatggaagacacagagctggatacacaaaggaaattgactacaatctagaatccaaaagattcttgaaggatgagggcaaaataaagccattttcggatacacaaaagctgagagcagctattgcaaagagactctcactaaagggcctccacaccaatgcacttcaggaagaaggaaagaggtttcggacggaaggtctgtgtgcagagggaatggctgtctcagaggcgactcaaactcagtatgtccagaaaggactcacaatctgctctcccagcccagcgcctcctgggactttggcctctgtggatgatgaccacagtcacttgggccagaaacatagacatcatcttgataccccttctccctcacctcccccatatccagtcacctccagtcctgtcatctttgcctcctaatctctttcatctctgcccttttctctccatctccatggccacccagctgccactgcattttgctcaccacctgcaattggccttccagcccctgaacccctctgatctgctcagcccgctctccacaccgaacccgaggctctctctttgaatggcaatctgatagtctcccccctgtttaaaacatgaaatggtatcctactaccctggggataaaaacaagacaaaaacgtttaagaggttagagaggtcttcatgattcagtccccacccacctctcagactcacctcccgccccagcctctctggactcttttggcccctcatgggtgccatcattttgcccacataggctcttgtctgtgctgttttcactatagagtgggtccttcccttctttctttgtctaattcatgacactcatcgtttagtgcatttggcacttcctccaggaagcctgccttgacctccctgactatatcagctctcccccattaaatgttcccctcgtgccatggtcccctcatctgtgacattgatcacatgagcaatttcacatttattcatgtagttagttatagtctggatcctcctttggattttaagttcctataggtaaaagccttcctctcctttggccaccgagatatctccaggactaccatggacatgcagtaaacattcaccagttgttgaatttatgagtgggtgagtggtgcctgccaccctagaatttcccttatttgaaattctagaataagcagattcacttctttttcacatccatgtgaatttttgttcttgtataaatgaatagtaagtaagagccataagaaataattggagaaagaaggaattgggaattgggaagagaaaagagagaaaaacaatagaggcagagcaggggctttttgcagtgatgcttggggagaagaaggaagccgaagggacagcaagtgggtagatggcaggtgactggccccaggttatccagagcagagctgagaccacccagtcctaaggggaaggggctgggaaggaagccactcagctctgccaagcagattaaatacagatcaacaagagcctttcccattttgaaaatgtacattgctctgtgttgctgggactgcagtgagacccaggaggcaggaataaacaattctgagtcataaaatcattaaggcatcaaacatttggatcgatgagcagacacaaaagaatatgcttcctatacacatgttaaaagcctaactcttgacaaggatctcaccgaatctcttgggcagaaggattctgtaatggaaagtaattgcacgccactcatctttgttaatttaagatgagtaaagggttattgattcactctttgtttcatgagctgttttcatattgaatttcagtgaacaaaaatatttttaataaggatttcatgggcttatttggcatctttctctcccaagctgcagagctatagatccaactgccagctggacaaacccaactcatctccagccatggcccctcctgatgtgagcctatctcaggttctggtaccacaatccacccagtgccaagccagacactcacgtatcaccctggatgccctccgcagcccctcacccatccaacagatgccccgtccctgtgcctgctaactccctcccacctctccagctcaaggcctccctcccacgtgctggatcctgcctgttcagacctgtcctgtctcctggtggccaaactggcctccccagtcagtccctgctgcagaaagtggtttctttctttctttctttctttctttcttttttttttttttttgagatgaagtcttattccatcgaccagggcctggagtgcaatggtgcaatcttggctcactgcaacctctgcctcctgggttcaagcaattcttttgcctcattcccctgagtagctgggattatagacatgcaccaccacgcatggctaatttttgtatttttagtaggggtggggtttcaccatgttggccaggctggtcttgaactcctgacctcaagtgatccactgatcttggcctcccaaagtgctgggattacccctgtgagccaccgcacccagcctggaaagtagtttctatagtacaaagccgggggtgctgctcccctgccccacacacctcagcacctccatgttgcttcctgtggagtagacactattgttttgtctgcccagtctcttcttttcttgtgggaatatgcttctggaatatttgtctggaaaaccctctccttttgataactgtctttgcctccctgggactgcagctgacgtgcttgcatgtgtgtgtgtgtgtgcgcgcgcgtgtgtgtgcgtgcatgcgtgtgtgtgtgtgtgtgtgtgttgggatcggcttccaaatcttcctactgggggaatgcccattatccattagatgccactcagtgggaagtggtgccccacccgtccgtggagacctaaggggcttaatagatcctccctgcatagccagagacggatacaatctgggctcagtgaatcggtgctttgactgctcacagcgtagctgagagcttactcccagaatggcgaaggtggcaaagagtccccatagctggtgttgttggctgccatcaccccttttatccaggggcacagctgaaatctgtgccactcggctctgctgggcaggtgggataaatctgccccagcctctgtgctgtccccatccctgctcctgctgcccagcagcctggagtccttctccagacttcctgtaactctctccccaagccaatgccctccctcgggtgaacaagggcccctccttgtgacccatggtgcctggcttgccttggccccagccctcctccctgtgccgaaatcatctctctgtggacctttctccctcatggactcccacctccttgtgggcaggaaccagcccttggccatgttccggctccctagtgcccagtatgtgtttggtgaatttgggggcatgggttggatgatcttggttcagttaccaaatctttctttcctgtccaatcagtcttccaggatctcaaccagttctctcactgcagagtctggagaagcccagccctcattgtgaagggagagccaccgtggtgctcacagcaagacacccagagtcccttccagacagggacacccctggagcgaccctgtttcagaatgaagttatctgggtgggaactcaccaagaatgcacagagggcgctgggctccaagcttcagcatatcctttcactggactccacacaggcctgcggagcaggtggacccaccattctcagaccccccagggccccatagacagcagatctgctgctttcaatcacacccactgcctctcatgccggagtgggggaaatggaacccgcaaagcctgcaggccagggagggtgggaaactggggtgatgtgagcccacagggtggagcactgtggactgaatgcctgtgtcccctgggttcatatgttgaacccctaactcccaatgtgatggtgtcaggaggtggagcctttgggaggtggttaggccgtgagggtggagacccatgctggggttggtgcccttatggttctcccatgtgaggacacagagggcagccatctacaagccaagaagagaggcctcaccagacaccaaacctgccggcaccttgctgtgagatttccagcccccagagctgtgagaaataaatttctgttgtttaaggcactcaatattttgttacagtagcccaagctgactgagcagatattcatatggaaagtgaattttgatctctacttcatgccgtacataaaagccaattccagattgactgtagatacagattggcaaagcaaaacagtacagtttctagaaagaaacaggaaaatatctgcatgaggtggtcaaatatttcctagagaggacacaaaaagcactaactacaaaataaacaatgataaattggactgcattaaaattaagaacatctgtttaacaaaagaccccacgaagagcgtgagaagccagagtgcagagtgggaggagaaatctgacctgagatgggaaattagaatatgaagaactccttcaagtcagcaagaagacaggcaagccgagaggaggacgggcaaacgacctcaacagacactttacagaagagatatccaggccaggtgcagtggctcatgcctgtaatcccagcactttgggaggctgaggccggtggatcacctgggatcaggagtccaagatcagcctggccaacatgtcgaagtgccatctctactaaaaatacaaaaatttgctgggcttggtggtgtgcacttgtaatcccagctacatgggaagcggaggtgggagaatttcttgaacccgggaggcagactttgcagtgagctgagatcgtgccactgcactccagcctgcgggacagagtgagactccatatcaaaaaaaaaaaaaaagatatacacataagagaatattcaactttattaatcattggggaaatacaaattaaagccaaagggagacaacactccttacccctaggaatggctaaagttaaaaagatgggaatacccatgtcaggaaggatttgaaacaactgcaactctcatatgctgcaggtgggaagtaggaggcaggcctccactccagaggaggggctcacatgacacacaccaaattgaggactagctagaacagggatggctggaagcagctttccataagacacacccaccagtgtgccacgtcagtttaccattgccatggcgacacccagaagttaatgcccctttccatggcaatgacctgatgacccagaagctaccatccttttcctagaaatttctgaataatccacctcttaatttgcatgtaattaaaagtggcaataaatctgactacacactacctctgagctgctgctccgggcacactgcctatggggtagccctgccccacagggagcagcccttctgctgctgctgctgctgtttacggctgcttcaataaaaactgctaactccattggctcgcccttaccttctttcttgggtgaagccacaaaccctcctggggtaagccccaattttggggctcgcctggcctgcatcagtgggagtttttggcagtataagttaagctggatacaagtatcctccatggtgtgacttctaggcagcatataatcaattaaaatgcaaacataagttaccaaaagacatgtacaagaatgttcctagcagcctattcataacagccagaactgggagtactccggatgttaccaagaggagaatgggtaagtcaattgtggtatattcatgtaatggaatactccacaatgagaacaaatgaaccacaccttcatgcaacagtgtggatggcgattcgagttcaaaaacaggcaccattagttggtcatattagaaataaggctgtgctggccaggcatggtggctcacaactgtaatcccagcactttggaaggccgaggcaggtggatcacttgagtccaagagtttgagatcagtctgggcaacgtgaggaaaccctgtgtctacaaaaatacaaaaattagctaggcgtagtggcacatgcctgtagtcccagggagggaggctgaggtgggaggattgcttgagcccgggaggtggaggttgcagtgagcaaagattgtgtcactgcgctccagcctgggtgacagagtaagaacctgtcagaaaagaaagaaagagaagaaagaaagaaaagaaagaaaagaaggaaggaaggagggaaggaaggaaggaaaagaaaataaaaggaaaaaagaaagaaagaaaagaaaagaaaggaaggaaagagagggaaggaaggaaggaaagaagggagggaggggagggaaagggagggaggggaggggagggaaaagataagaaaggaaaagaaaagacataaggttgtgttggccgggcgcagtggctcacgtctgtaatcccagcactttgggaggctgaggtgggtggattgcttgagcccaggagtttgagaccagcctgggcaacatagtggggccttgtctctacaaaaaataaaaaaattagccaggtgtggtggcaggtgcctgtagtcccagcttattcgagaggctgaggtgggaggattgcttgaacctgaaacgtggaggttgcagggagctgagatcgtgccactgcactccagcctgggggacagagtgagaccctgtctcaaaaaaaaaaaaaaaaaaaagaaggctgtgtttacccttggaaggtcacgagggagggaggtttctaggggttccagcaatgttctattttttgatccaagtactggttctcaagcatgctcactttgtgaaaatttactgggtggaactgtggggaaaagagagagatcagactgttactgtgtctgtgtagaaagaagtagacataagagactccattttgttcttgtggcccaggctgaagtgcaatggcgcgatctcggctcactgcaacctccacctcccaggttcaagcaattctcctgcctcagccttcccaagtagctgggattacaggcatgcgccaccacgcccggctaattttgtatttttagtagagatggggtttctccgtgtgggtcaggctggtctcaaactcccgatctcaggtgatctgcccacctcggcctcccaaagtcctgggattacaggtgtgagctaccgcgcccggctaatttttttgtattggttgcagtgagccgagatcgcgccattgcactccagcctgggcaacaagaacaaaatggagtctcttatgtctacttctttctacacagacacagtagcaatctgatctctctttcctttccccacatggaactcaatttgtgtttttcaaacaaagatgttacaccttgcagtttgtactctgttaaatgcttttaaattttacacacaaaactccaagggatcacatgagtgacagaattgaaacactcacactgttttttgggtttggaaaccacccccgctccatcccacacaggggcttgcggatccagctctgtgcccggcccccctcttgcacacatccggaaagcaggtgggcagggaaagcaggtgggtgtggtctggaggagagaggggcacaggctgagaatggtgggggggtccctgggccctgcatggtgagaggaggcccagggcagggccttctaaaatccaaggccccgacagcaggatccctggctgcctaggtctaggggcaggaccgaaggtcatcgaggacgggtggcctgggattgctggcaccaattcctgttacctcgagggtggggcctgccaaaaggagggattaggatgaggaggcaatgcctcccttaaggaattctgactgtgactcggtcgttgtagggagggggctgtgcatttccatgcaggcaagtcaggccctgggcacatcctggctcctgtcttggaagctggtgaacacccctagccagtgtggccgaaggcagcattctggaccagtccaggccttctgcacgggtatagcacagccctttgcctctcactatatgggctgtgccaggacatagtaccttgaccttcaagttcttttttttttttttttaaattgagacagggttttgctctgtcgtccaggctggagtgcagtggcacgatctcagctcactgaaacctccgcctcctgggctcaacggatcctcctgcctcagcctcctgagtagctgggactacaggcacctgccaccatgcctggccagttttaaaaaatattttgtagagagttgcccaggctggtctcaaattcctgggcccaggcagtcctcccacctttgcctcccaaagtgctgggattacagttgtgagctgccacacagccccccaggttgttatcactcatcacagaatgttctcagcttgttcttctgcgtgtggccaacctggaggcgcagggctgggttcccatgcggcctccttgccacagggtccaggaaggctgtttccaaaccctcttggcaggaagatacacttctggtgggattcaggtggaaagagactccctcactactggagagcaggctggggtctgtgtgcttggatagttatcccacagagagggacttcacaagcccgagagagaacagtcccaccaggaacagaggaggagtgaacaggacagagacacagacaggcaggacttttctgaacagtcatttgaaccagagaacaatttttcaatggacaataaatgttgcatataattgaaatctcggttacattccctgaaaagtgctttctgtgcaacctgagataagagactctcctggagctgcggtttcctcatctgttacacagtggttataacgccttgccgtttctatccgggatgactgggaaattcctctggaaaacaactacaaatgcaaaggtgaagtatttgatgatgtgtatatgagcacttcccagtgggttttgtggtctgtgggcatctccataggtcaataggtcttaatagtttaaaaaaagattccttggttaattaatttgatgaaacactgggttaaacacagtcaagcagatttccttactgcaggacttctcaaggcctttagtatgttaatacgcattgaaaatcgccaggagaggggtgttctatgtggcatatctcagacatatttacctagagaagggggtgtggtatgtgtgcgtgtgtgtgtgtgtgtgtgagagagagagagagagagaaagaagaaggaaggaaggaaagaaggaaggaaggaaaaggaaggaaggaagaggaaaggaaggaaggagggagggagagagggagggaaggaaggaaaaggaaagggaaggaaggaaggaaggaaggaaggaaaaaaattcacggggttagtgcagggaaattctgtggtaaattttaacagcaagtgaagaatgctgttccacatggatgcaggtattttttccaccatgccaattttacagtgcaaactgaatctaacaggttggattaatttggggatatgcattgctccactcagacagtctctgcatagattgccagggcgatgggaactaattcagaaaagcggaggaagactgtggcttgcaaagcccgcagatacatggctgctttgaggattttcttttgctcaaaggatttagggtgggggtggggagtggggaggacgggaggtgcttcttttgcttagaataaaattgcaaccttgaggccaaatgacagaggcttctcagcgtatggctggagaagtgcaaatgagaaacagttctgttttggtgagtgttttggctttgtttttgatgagttttgatcatcagtttgcttttttctaaaatacaattttttaaatgctcttataaaacacattttaattattgaaattccggcaagagaatgtgttattgcgcatataaagcactctaggtcttaactcctcattcccagagacgcggtgttttcccatcatgcatttcaataacatgaggtttcttcggtgcatccggtgacctttggtcatagcagagtagcctgggctgtgtgggagatgggttctgggtgagtgtgtgcgggccgaggcgtgggccctggttccctcttggcgctgttccgtctgctttttcattggaagaagtgaagcctctcatcta

SEQ ID NO: 78 - DNA, 13511 bp, Homo sapiens
cacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctgggggg

SEQ ID NO: 79 - DNA, 13581 bp, Homo sapiens
aacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgag

SEQ ID NO: 80 - DNA, 14866 bp, Homo sapiens
cacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgag

SEQ ID NO: 81 - DNA, 16479 bp, Homo sapiens
cacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccct

SEQ ID NO: 82 - DNA, 31633 bp, Homo sapiens
aggcctccatgcataaaaaaccactactctgagtttatacattaggtctctaaagaaaccaactcgttaacaaagacaaacttaggaaaccgggctgcaataccagatcactttcaacttgtcctgctcctgtgacttactgtaaggaagctcttaaacaaggtcctgattttataatgtcgtataccttagatatgagaaaatggaaaaaatatgacctaccttatagagtattacagatgattaactgagttatcacagagaatgtacctaatatcacataggataatacatgtccaatagatgtaagtgacaacatgagattaacgaggctgagtcacacctcaatatcatgatgctaggtaattattttctcaatacttccatagagattattagaaatactaatatcaaatatttttccccttagtggtgctccaggagctcagagattccaacagctctaagttccaggtctctgagtttatcctgatgggattccctggcattcacagttggcagcactggctctccctgcccctggctctgctctacctcttagctctcagtgccaacatccttatcctgatcatcatcaacaaagaggcagcactgcaccagcctatgtactatttcctgggcatcttggctatggcagacataggcctggctaccaccatcatgcctaagattttggccatcttatggttcaatgctaagaccatcagtctcctggagtgctttgctcagatgtatgccatacattgctttgtggccatggaatcaagtacctttgtctgcatggctattgatagatatgtagccatttgtcgaccgctacgatatccatcaatcatcactgaatcttttgttttcaaagcaaacgggttcatggcactgagaaacagcctgtgtctcatctcagtgcctctgttggctgcccagaggcattactgctcccagaatcaaattgagcactgtctttgttctaaccttggagtcactagcctatcttgtgatgatcgaagaatcaatagcattaaccaggtccttttggcttggacactcatgggaagtgacctgggtttgattattttatcatatgctctaatactttactctgtcctgaagctgaactctccagaagctgcatccaaggccttaagtacctgcacctcccacctcatcttaatccttttcttctacacagtcatcattgtgatttccattactcgtagtacaggaatgagagttccccttattccagttctacttaatgtgctacacaatgtcattccccctgccctgaaccccatggtatatgcactcaagaacaaggaactcaggcaaggcttatacaaggtacttagactggagtgaagggcacctgatatggaaaagatattcattttttgaaaattttcttcacatgtttttatatcatattctccaactgctgcaaatggcagaacaacaaagaaatagcataatgaattggtggcaacaactgacactttagaacaaaggagatagaagtaatatttgaaatatttgggagtcaagcaaaaatcttcatcacaaagggtaacagtgatgctatttgtctcaaggaattcaaagaaaagactaatgtaatctacatttcatgttcttacccacttgtcttagctaaaacttccagacagtgttgaatagaagtagttagagcagatattgtgtcaatctattccttttaattgaagagcttaatattttacatttgatgtaataattgataaaataggagatacttctgcattttcatgatttgctttattatgtgtcttatatttttaatttgcaaaggacttgaatagacatttctctaagattatatgcaaatgtccaaaaaatacatgaaaagatgctcaacataactagtcattaatcattaggcaaattcaatcaaaaccacaataacacacccctttaccccctatattatacaacaccacaataacacacccctttacccccatattatacatataaatgtactgcaaatttatttttttgcaataagagattagtgtttgcaagtatatggatacactgaaatctcaatacattgttgggaagtaaaaatggcacagtggctgtggaagagtttggcaattactaagaaacttcagtgccattaacatatgacccaggacccaacttttaataatacacccaacataattgaaaaaaatgttaatacaaaaacctgtacacaaatgtttacagtagcattattagccaaaaagtagaaacaacctgtatatctataagctgtgtcttgttctgttttgtgttgttacaacagaatacctaatactgagttagaaatataggtttatttagctcatagttctgcaggcagggtacttcaaggacatgtccctggcttcatctgaggactttggtgttgcctcataacatggcagacaaggtcaaagggaaaacagacatgtgcaaagagacaaaacccaacgggcttcccagctttataacaactcactgtcatgacaaatccatctcccagagaactgatccagttatgtaacagagaaaactcagtaactgccacaagaatagcaccaagtcattcatgaggaatccatccccaggacccaaacatctcttactgggccccacttcccaataccactacagtggggatcaaatttcaacctgatttttggtggagacaagcaaaccctatccacaccatagcagctactgaatggataaacaaaattaagtgtatctatactaggaattattatttaataaaaagtacctatatgagatgatagatatactaatcagcttcactataataattattttgctgtctctatcccataatttcatgctgtaaatctcaaatatatatagaataaaacttatcttacaaaaattcaacttgattgaattaaaaattgctaaatttaacaaaatgacatggaaaattttgtatagtaaagaggaaaaatataaaaagaataaattctcccaacaacaaacaaacaaaagtaaatgaagtactcgtacaatctgcagcatacatgaactttgaaaacattatgcttaggttagtgaagaaagccaaacacaaaaggccacctagtatctgattccatttgtatgaatatccagaataggttaagtctatagaaaaaaaaagcaaattagttgttagtagggaatggagactccaggcaataatgagagactaactaatagttatgaagtttccttttgaggtaatggaaatattgtgaaattagatagtggcaatggttgcacagcataatgaatgtagtgaaagtcacccaattgtacgttttcttttttcattttatataaaattaaggggtacaactgctttttgatacatggatgtatatccatgtatagcctggctgtggtgaagtctgggcttgtagtgtacccaccatagtgggtaccaccagcatagtgtatattgtacctactaaggaatttctcattcctcattccccttccatctgcccatcccccaaatctccaatatttatctatttcacactctatgcctatgtgtacacattaggtagttcccacttaaaagtgagaacatgtggtatttgcttttctgtttctgagatatttcacttaaaataatggcctcataatctatgcacgttgctgcaaaaaacattatttcatttgttttcttgactgaggagtattccattgtatatcataccacattttttttatccagtcatctgttgatggacacaggttgattccgtatctttccctgtgataaacatactagtgccaatatttttaagtgtaattattttaaatgcaattatcttcttttgggtagatacctaggattggcattgctggatggaatggtagttctagttttagtttcttgaatatttccgtactgttttccatagaggtcgtactaatttacattcaatataaaacaatataaaaaactgcaaaaattattctctacatgtatatttgttatataactttctgtaaattaaaagaacatagatgtctgagaacaggaaaatacttaaggaagtgtgtaaaacacataatgtgcctttatttaatcataatactgaacaatccttttttgaatgtgcttaatataaacattaactgaaaatgatagaatttttgtttaaaatttgatgttatccaaacgtttgtcaaaagtatatatagaaattgtatataaaagaaaaagtatcagaagttacctctacattatagaattaggttctaattatctctgtgatgtcctcatttttatttttacacttaataaaaacaaacatttttcttctaaataaaaatacataaaattagattaattattgtcttttattattgcgtttatttgcatcactattattatctcaaaattaaggcatctatttattgctagtttaatatttatatgtaataagtctgaacttttgattaatttttacaattccataatattcatcaccaatcttccttggaaataaattgcttgaaaaccaaggcccatgttttctgatgcttttttcaaagttcctagactaactctgagagtatgaagcactcaatgatgttacttaatacatgaaaacataaaaaaaggaagatgcaaagttgtctgtgtgagcaattaacacattctgtgcttgcttccaatttgtatgccacaaggccttaagcaaaaagaaacaactctgcaatcttattaataacataatttttaaaataaaaacatcctgtgttctttctcgcttccccccacatatacatggccacacataagcacatgtacagatacattcataggaaagtattcactagttacttatgaggcatcatataggtgatgagcatggagtgtttccaccctttcatctcctgtgagcgttgtcttaattccaacactgtgaccctaattatatgaaatatccccttgggacatataacacataattttctttaaaggctcatatcagtagtaaaggtatcaagggattttaatgttggggggagtacatgtacatatattgtaggattctcatgtgttctttgaccaagattctgaacatctgggccaaactgcattcagctcattctattggcatctggaaattaggtattaaaggacataaaaaggagacaggggtagtgacaggatttttcttgttgtagttcatagtagataaattggagagatgttttgccaaagtgtacagaatctttgagtgtatactattattattctcagaaattcagacttgatttcatccacttagtttgaaggtagaagtgttgcagacatttgttttgcagaatgtttatttccccaattttcaggttttcattcagcgaaatttttatgatgattttgaatatttataaacaaagcaaacaggaatcattggaaatgatgaaagtcaggtatgaaccacccgacaacatggagaaaaaatagaaaacagttcttgattatggtcagaattcttccataatcaagttcttacctgccctcctcttgttccttagaataagaatctaattaactggctttattcctagacagacatagttgtgactgtgtttcattgattttggacagcaaacatacttggatgaacctacagtcattttgagaaaagagcatggtctgtaaagactgagcatggtcaagtgaggaaacaaagttactatttacagagtttggggtgaaaatgcacaaccgatgatatcaaaatcatactttataaatggtggtatttgtttttaatgttatcacttaatagacctactcactcacagcataatacaaatctattattcttgcagaattataaagtaatatagtattaaaagcattttataagcttatatttcttgatgagactcatcactttttaaaaaaagttgtggccctcagcttcaaatcctgataatcgggaactcagcgtattggggactagaaggtattataatttccctttttcataaaatataaagctgaattatctttctttcatcaccagcaattagatagatttgtgtaaatttacattgccacagcagtcacattgcccagctgagtttccagcaagtataaatatcattctcagaggcaatttatagtacagttcaaacagacatctttctcaatcgaaatctctttccctttgactctcgggaagcacaaattagagaaatacagaaagcggcatgtaagataaaattaaaatgtagctgctgtattaaaagaagagagaattaacaaagtaaaataaatttttgctaactttaaaaaaagcgtttttaatttgttttggagaaagtattatataacttgtgcttagtgctatattattttgtatcagcaagatctttaactgagatgcttataaatgtaattgagatgagaactaaacttctcatgtaacaataaagccagttttagtaattaaaactatataaaaaggaaacacaagagacataaataggatatttatgtgtttcccttttatagttacagttttaatatatattaatataaggtatattaaatatatgagatataatgtaatatatattaaatatataatgtgagatattatatatgtaacataagataaatatgcaatgtgagataaagacagcataactcatcctaaagatatattttttattttcaacctagaggtatctttacgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaaatgacataatgactgttggaagttcattgtatagcagttatagcattgcctctgtgagcaggaaataaaaaaaagagtaatttcaaggagtgactgaccatcagtcttctttcccataatggctattttgttttccttgtagatcaatgactatatttgttctattatgtttaatatgtgatatatacactgtctgggtgtgtgccttaagcattaggtgttgacaggaaaaactgagtctagtcagtacatttggacctgaatatctggggtctttgttatcatgtagtccattctccaggccaacgttggccatgaactgaacaactctgtggtcaagaattgattaaatatttgctctattctaggtgctcaccatcttagagatctccgttgtattctgaaatgttaacagacttcattagttcctgtgggcttacctttcaaattaaatctgtcctaatggacatactgacaatattttcaatctagttttagcccaaactccacccttttggtttgcagaaaacctaaatacagaaaaatatgaatcatccccttgtagctgtagttttcttgaagcgaaatcatagaatgatcttagaggcaaataaataataataataataatccactttctaatatcagcaaaagaccacttgttttataagtaccatgatatatagaggatgaaggatcattaaaaatgcaagaacttatgagaatccaatgttttcctaagattacagtctagtctaattgactctagagtcaattcagtgaaaataaagatgcttatcatcttaaacaaaataaattgacattccctttagaacatagtgctttatattctacccatatcaaaacttcagccatagaatcaaatatttttgaggcttaaaataaagaatatttttatcaaatatttttgaggctatgtaatctccaaaactaagtttcttttgtatacagaagatgttcaatacgtttttcaaggcccacagaagaacaggcagtggtagaacaaggaccaacaaaacacttctgaatagtaagggagagaatatttggtgtgatagtgtgctgtgagaaaataagaacaaactcaaagttatgaccacagaatagatgaaaataggcttcacgggtctgaagaagtgggctatatcagccggaatgtgttgattaaaattttttaaaaggagcaagttgtgtgatgggggcatatcccatatagaaggatattggaggaaaactaagtaggctttctaatttaaaaatatcaatattgatatttatagttcctccttgacatattggaggtgacccacctgtcacttcagggatgtcactattgaaaatttaaggttgtataaaactggctatcctattttcatatgtgtcttttataaaatttttatgtccttattttatgaaatattagggctgtataaatgaactcttgtcacttttctaattgagatataattcaaataacattactatcatgtgaaatagaggcaactcactgaaaagaagacaaaacacagaaaagtatggaatgaggctgtcatctctctttttttcagatcacagaaaaaattcttttctctcagaaatgctgcttttagctttcacagccagagggaataaatagaatacttcctgcaaagattgtttcagtaattgaaatgtgaatattttatccaaagtgaaaatggaacatacaagccagtttgtctgctgcaccattttaaaagctaggagaataactcttctgacaactctcttactcatcctcatttctcagctactgtaatctgcacccatccctttaataagaataaagaaatctcagttcagaaatctgctcaccctaatgatcagtgatgttgagctttttctcatatgattgttggccacatacgtgttttcttctgagatgtgtctgttcatatccctttcctactttttaataggttgtttttttcttctaaatttaagttccttaaagatctggatattagacctttgtcagatacatagtttgcaaaaatgttctcctatcctgtaggctgtctgtttactctgttgatagtttcttttgctgtgcataactcccataggagggagagaatcaggaaaaatatctaatggatactaggcctaatacctgggtgatgaaataatctgtacaacaaacctccatgacacatattaacttatgtaacaaacttccaaatcctgcacatgtaagcctgaacttaaaataaaagcttaaacaaaagtaaatctgcttaccctgaaaactaccggagttcctcaagaaactgaagacctatccatggatcaagtcatatttatgtctatatgatcctcttggtcctgaaggagaaatataatacctacattgagaccttgggaggcaagtggaggagggaacatttctattatctgtccatatgtgtgtgtacgtgcatgcatgcatgtgtgtatgttgtggatgttttatattctgaagttgagtaatggaaaacacttggttgttattgtctctactgtagtctcagaagagaagtgatttccccggtgaatgcatttgtgtatgtgtgtatgtttagaatatgaacaaaagagaattaagaatcaggtatatctgggtcctaaggatactggctaagccagtgggagcagtcttcagaactattttgacgtcattatagtctgggactcctggggacataattttttacaggtacagcagagatacatatgtctgaaaccacttggagtatcataattaaatccttttgagaggcacacctgcctcttttttcaaaacttagcacaatgtcatgcacaaaattagtactgaaaaagatgtttttaaagaaaacttaaataatgccggtatgcaaacaattgagttgtatatgtgaacttttatttcatgtctccaatatatttgcttattatttataacatttttatgaacatgatttggaattatctagacatatttttcactctgtgaaaaatgagtaatttgcttctttctttcctatttgtatgattttttcttgccttattgcactggttaagatcttccttctatgcaatgtttaccaagagtagcaataatgaatatctttgcttcattactaaggactgggtataatgatgcctactgagggtaatgaaacttagttccaaatgattatataaagacctagactaatggtacagtgcagaagcatagctatgccataataaaaaataatatatttcacttaacaatgccctctaggttcatctatgttgttgcttgtgacagaattttctgaattttttaaggccaaatagtattccattgtgtacatattccatatttttaaacccattcattcattgatggacacattttgactattgcaaataatactgcaatgaacacgaggttgcagacatctcattaacatattgatttcaatttctttgagcatatacccagtgagactgctggatcatatggtaattccgtgtttgattttttgaggaacctctatactgttttctaaaagaactatactaatttaaattcccaacaagagtgtataatggttcacttttctcaacattttcatcaacagctcttatctttcatccttttgataatagccaatgtaacaggtgtgaggtaatgtcttattatggttttaatttgcagttctctaaagattagtgatgttgagcatttcctcacatactttttggccacttgtatgtcttcttttgagacatttttattcaagtcctttctctactttttatagggttttttttttggcaattgagtagtttgaattccttgtttattttggatattagtccttatccagcatatgatttgcaaattttttttcaatctgagaagttatctctctattggtatttttggctatacagaagcattttaatataatccaatctcaattgtttatttttgcttttgttgcctggtgcttttggggtcacagtcattaaatctttgcccaaaccaatgtcatggagcttttctcctatgttttcttttattaatttaatgtttcaagttttatatttgaatctttaatttattttgagttgattcttgtataagagacaagctaagggttcatttatattttctgtatgtggatatcaatttttcccaataccatttattgaagacaggtccttttctttttaaatgtgtggtttgcttctgggatctctagcccattccattggtcaatgtatctgtttttatgccagtaccatgctgttctgattactatagctttgcaatatattttgaaattctgtagtgtggtgtctccagctttattctttttggtcaatattgctttgactaattaaggtcttttatagttccatagaaattttaagatttttttccatttctgtgaagaatgacattggaatttttatagagattgcattgaatctgcagattgctttgggctttatagacattttaagaatattaattcttccagtccatgaacacgagatatcattccatttatttatgtcatcttcaatttctcttttttaacttttattttagatttggtggtacttatatttctaattttatactgttactatattttattgattgtcatagcattataatacatttttaaattagtgtaagcactgtcaattaggtccttctttaaaaagattctttggatatcctttgtcctttgcatttccatagataatttagaattaattgtgtaatttctacaaaaagctgtcttggatttttgtgaagacaatattgaacctatagatcaatttgagattccacaaactgcactcataggatggcaaacttaatttataaatgttgtatgtattctcattgctacactggccagccactctcctgtctctctccctcttcttgggcccccctattccttcaggcacaacaatattgaaattaggccaataaatgaccctgcaatggtcactaagtgtatagtgaaaggaagagtcacatacctctcaatttaaattaaaaaatatatatataaatgattaaacttagtaagaaaggcatgacaaaagctgagatagaccaaaagccagtcctcttatgccaaacagttatccaagttgtgaatgcaaaagaaaagttattgaaggaaattaaagggatactgcaatgaacacataaatgacaagaaagcaaaacagcctaatggctgatataaagaaagtttaagtggtctagaccaaaccagccacgatattcccttaagccaaaacctaatctagagcaaggcatcaactattttaattcttttaagcctgataaatgtaaggatgttgcagaagaaaagtttaagttagcagaagttggttcatgagggaaagaagccatctccataacacgcaagtgcaagtgttgatgtagaacctgcagcaagttatccagaagatcccacgatcattgataaaaatggattcactaaacaacagattttcaatgtagatgaaacagccttctctctctctctctctctctctctctctctctctctatatatatatatatatatatatatatatttatttatttatttatttatttattttgagacagagtttcaccattgtcacccaggctggagggcagtggcccgatcttggctcactgcaacctctgcctccccggttcaagtgattctcctgcctcagcctcccaagtagctaggattacaggctcccttgccacgtctggctaactttttgtgtttttaatagagacagggtttcaccatgttggctagactggtctcaaactcctgaccgcaagtgatccactcaccttggcctcccaaaatgctgggattacaggcatgagccaccgtgtctggctgaaacagccttcttttggaagagcatgtcatcatagagaggataagtcaatgtctgtcttcaaaacttcaaagaacaggctgactatcttgttaggggctaatgcagctggtgactttaagttgaaaccaatgctcatttaccaatccccaaatcctagggcccttaataattattctaactctatgttgtctttgctctctatatagaacatcaaagcctggatgacagtacatacgtttagagcatggtttattgaatattttaagcccactgttgaaacctactgctcaagaaaaatggattcctttcaaaatattcctgctcattgacaatgtgcctggcaactcaagagctgtaatggaaatgtacagggagattaatttattttcaaggctgctcatacaacatccattctgcagcacatggaacaagaagcaattgtgactttcaagtcttatttatttaagaaatacattttgtaagactatagctgccatagatggtaattgttctgatgtgcatgtgtaaagtcaattgaaaaccttctagaaaggattcaccatattagataccattaacaacatttataattcatgggatgaggtcaaaatatcaacattaataggggttagaaataagttagttctaacccttataaatggcttcgatggagtcaagactttactggaggaaatcactaaagatgtgatgtaaatagcaaaagaaatagaattgaaaacgaaacctgataatgtgactgaattgctgcaatctcatgataaaacatgaataatgtggagttgatttttgtggatgagcaaagaaaatggttccttgagatggaatctactcttggtgaagatgttgtgaacatcgttgaaatgacaacaaaggattttgaatattacctggatttagttgagaaagcagtagtatggtttgagaggattaactctgaaagctgcttcactgtgggtaaaatgctatcaaatagcattacataccacaggcaaatctttcatgaaagtaaaagtcaatcaatggggcaacatttattgtcctattttaagaaattgccacaatcactccaaacttcagcaaccaccaccctaagtagtcaacagcagtcaaagactctccaccagcaaaaagattatggctcacggaaggctcagataatcgctagcgttttttagcaatagcatatttttaaaaaggtctatatattttttaggcataatgctattgtatacttaatagaccatggtatagtgtaaacatacattttatgtgcactgagaaacccaaaattcatgtgactcacgttattgcagtggtctgaaaccaaatctgtgctatgtctaaggtatgcctgtattataaccagataaatagacttcattttaatttctcacacctattcataagtatattattatatatgcatagcatttataagcagatatacctgcttaatacagttttaattcagaaaacaaacaaaaagcaaaaaaaaaaaccgaagtaaggatatt

SEQ ID NO: 83 - DNA, 33495 bp, Homo sapiens
aggcctccatgcataaaaaaccactactctgagtttatacattaggtctctaaagaaaccaactcgttaacaaagacaaacttaggaaaccgggctgcaataccagatcactttcaacttgtcctgctcctgtgacttactgtaaggaagctcttaaacaaggtcctgattttataatgtcgtataccttagatatgagaaaatggaaaaaatatgacctaccttatagagtattacagatgattaactgagttatcacagagaatgtacctaatatcacataggataatacatgtccaatagatgtaagtgacaacatgagattaacgaggctgagtcacacctcaatatcatgatgctaggtaattattttctcaatacttccatagagattattagaaatactaatatcaaatatttttccccttagtggtgctccaggagctcagagattccaacagctctaagttccaggtctctgagtttatcctgatgggattccctggcattcacagttggcagcactggctctccctgcccctggctctgctctacctcttagctctcagtgccaacatccttatcctgatcatcatcaacaaagaggcagcactgcaccagcctatgtactatttcctgggcatcttggctatggcagacataggcctggctaccaccatcatgcctaagattttggccatcttatggttcaatgctaagaccatcagtctcctggagtgctttgctcagatgtatgccatacattgctttgtggccatggaatcaagtacctttgtctgcatggctattgatagatatgtagccatttgtcgaccgctacgatatccatcaatcatcactgaatcttttgttttcaaagcaaacgggttcatggcactgagaaacagcctgtgtctcatctcagtgcctctgttggctgcccagaggcattactgctcccagaatcaaattgagcactgtctttgttctaaccttggagtcactagcctatcttgtgatgatcgaagaatcaatagcattaaccaggtccttttggcttggacactcatgggaagtgacctgggtttgattattttatcatatgctctaatactttactctgtcctgaagctgaactctccagaagctgcatccaaggccttaagtacctgcacctcccacctcatcttaatccttttcttctacacagtcatcattgtgatttccattactcgtagtacaggaatgagagttccccttattccagttctacttaatgtgctacacaatgtcattccccctgccctgaaccccatggtatatgcactcaagaacaaggaactcaggcaaggcttatacaaggtacttagactggagtgaagggcacctgatatggaaaagatattcattttttgaaaattttcttcacatgtttttatatcatattctccaactgctgcaaatggcagaacaacaaagaaatagcataatgaattggtggcaacaactgacactttagaacaaaggagatagaagtaatatttgaaatatttgggagtcaagcaaaaatcttcatcacaaagggtaacagtgatgctatttgtctcaaggaattcaaagaaaagactaatgtaatctacatttcatgttcttacccacttgtcttagctaaaacttccagacagtgttgaatagaagtagttagagcagatattgtgtcaatctattccttttaattgaagagcttaatattttacatttgatgtaataattgataaaataggagatacttctgcattttcatgatttgctttattatgtgtcttatatttttaatttgcaaaggacttgaatagacatttctctaagattatatgcaaatgtccaaaaaatacatgaaaagatgctcaacataactagtcattaatcattaggcaaattcaatcaaaaccacaataacacacccctttaccccctatattatacaacaccacaataacacacccctttacccccatattatacatataaatgtactgcaaatttatttttttgcaataagagattagtgtttgcaagtatatggatacactgaaatctcaatacattgttgggaagtaaaaatggcacagtggctgtggaagagtttggcaattactaagaaacttcagtgccattaacatatgacccaggacccaacttttaataatacacccaacataattgaaaaaaatgttaatacaaaaacctgtacacaaatgtttacagtagcattattagccaaaaagtagaaacaacctgtatatctataagctgtgtcttgttctgttttgtgttgttacaacagaatacctaatactgagttagaaatataggtttatttagctcatagttctgcaggcagggtacttcaaggacatgtccctggcttcatctgaggactttggtgttgcctcataacatggcagacaaggtcaaagggaaaacagacatgtgcaaagagacaaaacccaacgggcttcccagctttataacaactcactgtcatgacaaatccatctcccagagaactgatccagttatgtaacagagaaaactcagtaactgccacaagaatagcaccaagtcattcatgaggaatccatccccaggacccaaacatctcttactgggccccacttcccaataccactacagtggggatcaaatttcaacctgatttttggtggagacaagcaaaccctatccacaccatagcagctactgaatggataaacaaaattaagtgtatctatactaggaattattatttaataaaaagtacctatatgagatgatagatatactaatcagcttcactataataattattttgctgtctctatcccataatttcatgctgtaaatctcaaatatatatagaataaaacttatcttacaaaaattcaacttgattgaattaaaaattgctaaatttaacaaaatgacatggaaaattttgtatagtaaagaggaaaaatataaaaagaataaattctcccaacaacaaacaaacaaaagtaaatgaagtactcgtacaatctgcagcatacatgaactttgaaaacattatgcttaggttagtgaagaaagccaaacacaaaaggccacctagtatctgattccatttgtatgaatatccagaataggttaagtctatagaaaaaaaaagcaaattagttgttagtagggaatggagactccaggcaataatgagagactaactaatagttatgaagtttccttttgaggtaatggaaatattgtgaaattagatagtggcaatggttgcacagcataatgaatgtagtgaaagtcacccaattgtacgttttcttttttcattttatataaaattaaggggtacaactgctttttgatacatggatgtatatccatgtatagcctggctgtggtgaagtctgggcttgtagtgtacccaccatagtgggtaccaccagcatagtgtatattgtacctactaaggaatttctcattcctcattccccttccatctgcccatcccccaaatctccaatatttatctatttcacactctatgcctatgtgtacacattaggtagttcccacttaaaagtgagaacatgtggtatttgcttttctgtttctgagatatttcacttaaaataatggcctcataatctatgcacgttgctgcaaaaaacattatttcatttgttttcttgactgaggagtattccattgtatatcataccacattttttttatccagtcatctgttgatggacacaggttgattccgtatctttccctgtgataaacatactagtgccaatatttttaagtgtaattattttaaatgcaattatcttcttttgggtagatacctaggattggcattgctggatggaatggtagttctagttttagtttcttgaatatttccgtactgttttccatagaggtcgtactaatttacattcaatataaaacaatataaaaaactgcaaaaattattctctacatgtatatttgttatataactttctgtaaattaaaagaacatagatgtctgagaacaggaaaatacttaaggaagtgtgtaaaacacataatgtgcctttatttaatcataatactgaacaatccttttttgaatgtgcttaatataaacattaactgaaaatgatagaatttttgtttaaaatttgatgttatccaaacgtttgtcaaaagtatatatagaaattgtatataaaagaaaaagtatcagaagttacctctacattatagaattaggttctaattatctctgtgatgtcctcatttttatttttacacttaataaaaacaaacatttttcttctaaataaaaatacataaaattagattaattattgtcttttattattgcgtttatttgcatcactattattatctcaaaattaaggcatctatttattgctagtttaatatttatatgtaataagtctgaacttttgattaatttttacaattccataatattcatcaccaatcttccttggaaataaattgcttgaaaaccaaggcccatgttttctgatgcttttttcaaagttcctagactaactctgagagtatgaagcactcaatgatgttacttaatacatgaaaacataaaaaaaggaagatgcaaagttgtctgtgtgagcaattaacacattctgtgcttgcttccaatttgtatgccacaaggccttaagcaaaaagaaacaactctgcaatcttattaataacataatttttaaaataaaaacatcctgtgttctttctcgcttccccccacatatacatggccacacataagcacatgtacagatacattcataggaaagtattcactagttacttatgaggcatcatataggtgatgagcatggagtgtttccaccctttcatctcctgtgagcgttgtcttaattccaacactgtgaccctaattatatgaaatatccccttgggacatataacacataattttctttaaaggctcatatcagtagtaaaggtatcaagggattttaatgttggggggagtacatgtacatatattgtaggattctcatgtgttctttgaccaagattctgaacatctgggccaaactgcattcagctcattctattggcatctggaaattaggtattaaaggacataaaaaggagacaggggtagtgacaggatttttcttgttgtagttcatagtagataaattggagagatgttttgccaaagtgtacagaatctttgagtgtatactattattattctcagaaattcagacttgatttcatccacttagtttgaaggtagaagtgttgcagacatttgttttgcagaatgtttatttccccaattttcaggttttcattcagcgaaatttttatgatgattttgaatatttataaacaaagcaaacaggaatcattggaaatgatgaaagtcaggtatgaaccacccgacaacatggagaaaaaatagaaaacagttcttgattatggtcagaattcttccataatcaagttcttacctgccctcctcttgttccttagaataagaatctaattaactggctttattcctagacagacatagttgtgactgtgtttcattgattttggacagcaaacatacttggatgaacctacagtcattttgagaaaagagcatggtctgtaaagactgagcatggtcaagtgaggaaacaaagttactatttacagagtttggggtgaaaatgcacaaccgatgatatcaaaatcatactttataaatggtggtatttgtttttaatgttatcacttaatagacctactcactcacagcataatacaaatctattattcttgcagaattataaagtaatatagtattaaaagcattttataagcttatatttcttgatgagactcatcactttttaaaaaaagttgtggccctcagcttcaaatcctgataatcgggaactcagcgtattggggactagaaggtattataatttccctttttcataaaatataaagctgaattatctttctttcatcaccagcaattagatagatttgtgtaaatttacattgccacagcagtcacattgcccagctgagtttccagcaagtataaatatcattctcagaggcaatttatagtacagttcaaacagacatctttctcaatcgaaatctctttccctttgactctcgggaagcacaaattagagaaatacagaaagcggcatgtaagataaaattaaaatgtagctgctgtattaaaagaagagagaattaacaaagtaaaataaatttttgctaactttaaaaaaagcgtttttaatttgttttggagaaagtattatataacttgtgcttagtgctatattattttgtatcagcaagatctttaactgagatgcttataaatgtaattgagatgagaactaaacttctcatgtaacaataaagccagttttagtaattaaaactatataaaaaggaaacacaagagacataaataggatatttatgtgtttcccttttatagttacagttttaatatatattaatataaggtatattaaatatatgagatataatgtaatatatattaaatatataatgtgagatattatatatgtaacataagataaatatgcaatgtgagataaagacagcataactcatcctaaagatatattttttattttcaacctagaggtatctttacgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaaatgacataatgactgttggaagttcattgtatagcagttatagcattgcctctgtgagcaggaaataaaaaaaagagtaatttcaaggagtgactgaccatcagtcttctttcccataatggctattttgttttccttgtagatcaatgactatatttgttctattatgtttaatatgtgatatatacactgtctgggtgtgtgccttaagcattaggtgttgacaggaaaaactgagtctagtcagtacatttggacctgaatatctggggtctttgttatcatgtagtccattctccaggccaacgttggccatgaactgaacaactctgtggtcaagaattgattaaatatttgctctattctaggtgctcaccatcttagagatctccgttgtattctgaaatgttaacagacttcattagttcctgtgggcttacctttcaaattaaatctgtcctaatggacatactgacaatattttcaatctagttttagcccaaactccacccttttggtttgcagaaaacctaaatacagaaaaatatgaatcatccccttgtagctgtagttttcttgaagcgaaatcatagaatgatcttagaggcaaataaataataataataataatccactttctaatatcagcaaaagaccacttgttttataagtaccatgatatatagaggatgaaggatcattaaaaatgcaagaacttatgagaatccaatgttttcctaagattacagtctagtctaattgactctagagtcaattcagtgaaaataaagatgcttatcatcttaaacaaaataaattgacattccctttagaacatagtgctttatattctacccatatcaaaacttcagccatagaatcaaatatttttgaggcttaaaataaagaatatttttatcaaatatttttgaggctatgtaatctccaaaactaagtttcttttgtatacagaagatgttcaatacgtttttcaaggcccacagaagaacaggcagtggtagaacaaggaccaacaaaacacttctgaatagtaagggagagaatatttggtgtgatagtgtgctgtgagaaaataagaacaaactcaaagttatgaccacagaatagatgaaaataggcttcacgggtctgaagaagtgggctatatcagccggaatgtgttgattaaaattttttaaaaggagcaagttgtgtgatgggggcatatcccatatagaaggatattggaggaaaactaagtaggctttctaatttaaaaatatcaatattgatatttatagttcctccttgacatattggaggtgacccacctgtcacttcagggatgtcactattgaaaatttaaggttgtataaaactggctatcctattttcatatgtgtcttttataaaatttttatgtccttattttatgaaatattagggctgtataaatgaactcttgtcacttttctaattgagatataattcaaataacattactatcatgtgaaatagaggcaactcactgaaaagaagacaaaacacagaaaagtatggaatgaggctgtcatctctctttttttcagatcacagaaaaaattcttttctctcagaaatgctgcttttagctttcacagccagagggaataaatagaatacttcctgcaaagattgtttcagtaattgaaatgtgaatattttatccaaagtgaaaatggaacatacaagccagtttgtctgctgcaccattttaaaagctaggagaataactcttctgacaactctcttactcatcctcatttctcagctactgtaatctgcacccatccctttaataagaataaagaaatctcagttcagaaatctgctcaccctaatgatcagtgatgttgagctttttctcatatgattgttggccacatacgtgttttcttctgagatgtgtctgttcatatccctttcctactttttaataggttgtttttttcttctaaatttaagttccttaaagatctggatattagacctttgtcagatacatagtttgcaaaaatgttctcctatcctgtaggctgtctgtttactctgttgatagtttcttttgctgtgcataactcccataggagggagagaatcaggaaaaatatctaatggatactaggcctaatacctgggtgatgaaataatctgtacaacaaacctccatgacacatattaacttatgtaacaaacttccaaatcctgcacatgtaagcctgaacttaaaataaaagcttaaacaaaagtaaatctgcttaccctgaaaactaccggagttcctcaagaaactgaagacctatccatggatcaagtcatatttatgtctatatgatcctcttggtcctgaaggagaaatataatacctacattgagaccttgggaggcaagtggaggagggaacatttctattatctgtccatatgtgtgtgtacgtgcatgcatgcatgtgtgtatgttgtggatgttttatattctgaagttgagtaatggaaaacacttggttgttattgtctctactgtagtctcagaagagaagtgatttccccggtgaatgcatttgtgtatgtgtgtatgtttagaatatgaacaaaagagaattaagaatcaggtatatctgggtcctaaggatactggctaagccagtgggagcagtcttcagaactattttgacgtcattatagtctgggactcctggggacataattttttacaggtacagcagagatacatatgtctgaaaccacttggagtatcataattaaatccttttgagaggcacacctgcctcttttttcaaaacttagcacaatgtcatgcacaaaattagtactgaaaaagatgtttttaaagaaaacttaaataatgccggtatgcaaacaattgagttgtatatgtgaacttttatttcatgtctccaatatatttgcttattatttataacatttttatgaacatgatttggaattatctagacatatttttcactctgtgaaaaatgagtaatttgcttctttctttcctatttgtatgattttttcttgccttattgcactggttaagatcttccttctatgcaatgtttaccaagagtagcaataatgaatatctttgcttcattactaaggactgggtataatgatgcctactgagggtaatgaaacttagttccaaatgattatataaagacctagactaatggtacagtgcagaagcatagctatgccataataaaaaataatatatttcacttaacaatgccctctaggttcatctatgttgttgcttgtgacagaattttctgaattttttaaggccaaatagtattccattgtgtacatattccatatttttaaacccattcattcattgatggacacattttgactattgcaaataatactgcaatgaacacgaggttgcagacatctcattaacatattgatttcaatttctttgagcatatacccagtgagactgctggatcatatggtaattccgtgtttgattttttgaggaacctctatactgttttctaaaagaactatactaatttaaattcccaacaagagtgtataatggttcacttttctcaacattttcatcaacagctcttatctttcatccttttgataatagccaatgtaacaggtgtgaggtaatgtcttattatggttttaatttgcagttctctaaagattagtgatgttgagcatttcctcacatactttttggccacttgtatgtcttcttttgagacatttttattcaagtcctttctctactttttatagggttttttttttggcaattgagtagtttgaattccttgtttattttggatattagtccttatccagcatatgatttgcaaattttttttcaatctgagaagttatctctctattggtatttttggctatacagaagcattttaatataatccaatctcaattgtttatttttgcttttgttgcctggtgcttttggggtcacagtcattaaatctttgcccaaaccaatgtcatggagcttttctcctatgttttcttttattaatttaatgtttcaagttttatatttgaatctttaatttattttgagttgattcttgtataagagacaagctaagggttcatttatattttctgtatgtggatatcaatttttcccaataccatttattgaagacaggtccttttctttttaaatgtgtggtttgcttctgggatctctagcccattccattggtcaatgtatctgtttttatgccagtaccatgctgttctgattactatagctttgcaatatattttgaaattctgtagtgtggtgtctccagctttattctttttggtcaatattgctttgactaattaaggtcttttatagttccatagaaattttaagatttttttccatttctgtgaagaatgacattggaatttttatagagattgcattgaatctgcagattgctttgggctttatagacattttaagaatattaattcttccagtccatgaacacgagatatcattccatttatttatgtcatcttcaatttctcttttttaacttttattttagatttggtggtacttatatttctaattttatactgttactatattttattgattgtcatagcattataatacatttttaaattagtgtaagcactgtcaattaggtccttctttaaaaagattctttggatatcctttgtcctttgcatttccatagataatttagaattaattgtgtaatttctacaaaaagctgtcttggatttttgtgaagacaatattgaacctatagatcaatttgagattccacaaactgcactcataggatggcaaacttaatttataaatgttgtatgtattctcattgctacactggccagccactctcctgtctctctccctcttcttgggcccccctattccttcaggcacaacaatattgaaattaggccaataaatgaccctgcaatggtcactaagtgtatagtgaaaggaagagtcacatacctctcaatttaaattaaaaaatatatatataaatgattaaacttagtaagaaaggcatgacaaaagctgagatagaccaaaagccagtcctcttatgccaaacagttatccaagttgtgaatgcaaaagaaaagttattgaaggaaattaaagggatactgcaatgaacacataaatgacaagaaagcaaaacagcctaatggctgatataaagaaagtttaagtggtctagaccaaaccagccacgatattcccttaagccaaaacctaatctagagcaaggcatcaactattttaattcttttaagcctgataaatgtaaggatgttgcagaagaaaagtttaagttagcagaagttggttcatgagggaaagaagccatctccataacacgcaagtgcaagtgttgatgtagaacctgcagcaagttatccagaagatcccacgatcattgataaaaatggattcactaaacaacagattttcaatgtagatgaaacagccttctctctctctctctctctctctctctctctctctctatatatatatatatatatatatatatatttatttatttatttatttatttattttgagacagagtttcaccattgtcacccaggctggagggcagtggcccgatcttggctcactgcaacctctgcctccccggttcaagtgattctcctgcctcagcctcccaagtagctaggattacaggctcccttgccacgtctggctaactttttgtgtttttaatagagacagggtttcaccatgttggctagactggtctcaaactcctgaccgcaagtgatccactcaccttggcctcccaaaatgctgggattacaggcatgagccaccgtgtctggctgaaacagccttcttttggaagagcatgtcatcatagagaggataagtcaatgtctgtcttcaaaacttcaaagaacaggctgactatcttgttaggggctaatgcagctggtgactttaagttgaaaccaatgctcatttaccaatccccaaatcctagggcccttaataattattctaactctatgttgtctttgctctctatatagaacatcaaagcctggatgacagtacatacgtttagagcatggtttattgaatattttaagcccactgttgaaacctactgctcaagaaaaatggattcctttcaaaatattcctgctcattgacaatgtgcctggcaactcaagagctgtaatggaaatgtacagggagattaatttattttcaaggctgctcatacaacatccattctgcagcacatggaacaagaagcaattgtgactttcaagtcttatttatttaagaaatacattttgtaagactatagctgccatagatggtaattgttctgatgtgcatgtgtaaagtcaattgaaaaccttctagaaaggattcaccatattagataccattaacaacatttataattcatgggatgaggtcaaaatatcaacattaataggggttagaaataagttagttctaacccttataaatggcttcgatggagtcaagactttactggaggaaatcactaaagatgtgatgtaaatagcaaaagaaatagaattgaaaacgaaacctgataatgtgactgaattgctgcaatctcatgataaaacatgaataatgtggagttgatttttgtggatgagcaaagaaaatggttccttgagatggaatctactcttggtgaagatgttgtgaacatcgttgaaatgacaacaaaggattttgaatattacctggatttagttgagaaagcagtagtatggtttgagaggattaactctgaaagctgcttcactgtgggtaaaatgctatcaaatagcattacataccacaggcaaatctttcatgaaagtaaaagtcaatcaatggggcaacatttattgtcctattttaagaaattgccacaatcactccaaacttcagcaaccaccaccctaagtagtcaacagcagtcaaagactctccaccagcaaaaagattatggctcacggaaggctcagataatcgctagcgttttttagcaatagcatatttttaaaaaggtctatatattttttaggcataatgctattgtatacttaatagaccatggtatagtgtaaacatacattttatgtgcactgagaaacccaaaattcatgtgactcacgttattgcagtggtctgaaaccaaatctgtgctatgtctaaggtatgcctgtattataaccagataaatagacttcattttaatttctcacacctattcataagtatattattatatatgcatagcatttataagcagatatacctgcttaatacagttttaattcagaaaacaaacaaaaagcaaaaaaaaaaaccgaagtaaggatatttttcaaagattttctgacttgaggaactttgtagcagagtctaggacttgaagcattacctagcatctgatagcttactatttatttaagtattattttaaaaatgctattaatattgtaactcagcaagttttaaaaggaaagctgacatctatgtttttcatttattagctatctgctctggaataaagctacacaccaccatattgttaataattgaagactcactctgggctgaagctctatggcatagagcttattttatgtgtttcggtaagcgagctggctcactgaaaaagaaaaaaggacctacatttgtggggattctgtccatcgtagctgcttgtgctagaagaaagatgtgccattacatcatattactgtttaccgttttctcctctccatagactgcattcattctacaaacccaaggtattaaattgtggtcacgatgttctttgattcctttccagacatctgtctactttgaggataatttcaatcccagcctttgatgtttccttaaacttgatcaagatgtactaacggggattgcaacagaaaagaatgctatatttctactgaagtaaaggggaacagtgatggagagacagtgcatttaacagtgttaacctttcaaataaagacataactcagccttattgcagaatatatattttaatgagcccctagcataaaacattctgaaattgtttactcaatatttttgagaaagctttaaaatacccacatggcacatgaataaatatataaaatgttatgaaactggaatggaactgccctagggagtcaggtaaaattccaggtttatgattcaatagatgctagacacttcacatgtcccatcaataataaaatttgagatttttttctgtcaggcatagacatattctaattatagatctattttcaacaaaggtaaattcacctccttttcagagacctatgggacatctatctgtaaagccccaaagaatttttttaccttggcttggaaaatccccagagaagatattaagtttgttacatagggttcctcatcaatattgtgcaattatttctaagtaatatcagtcatgaatgggaatttaaaaacatctggcaccagggtgagtttggatgaaaatggttcagataaaaagaaaacaaatatataaaatgcacaaaattgctactatataggagggatttaaatgagagagcagttgaataaggaagttctgaattacttcactctttagaattttgaaaccaaggaatttgcaaattgccttgaggagggagaagagggagaaaattaaatgtagtttaggtcctgaaggaaggggattccatgaggctgatgtgacaaggaccaaagagatataggcaagcatatttctatacaataatagaaaaacttctctgccctccatagatggaagagtattcctcaggaagcagtaacatctctaccattgaaaatgaattagtgtaagagttaggatggagggtgggaagacggaaaagatcagaaaaaataactaatgggtactagacttattacctgagtgatgaaataatctccacaacaaacccccatgacaaaaatttaactatggaacaaacctgcacttgtatccctgaacttaaaagttaaaaaaaagaacacttggaagaaattctagtgatcatgtagcccaagttcttgacgacattaatgacatatgccgttttcccactgcttgatacctcagatggcagtgatcccattatcttattagaaaattttatctgtgtgaatgggcaacattcctcaaagccaaatttacatttctgtaacatttttctatttataatat

SEQ ID NO: 84 - DNA, 111053 bp, Homo sapiens
gtatagttctcaaccatgaaatctcctgggggtaatcttacctgtttaaaataaagggaaatgtaccctgtttctttcaccaaggcaccatgaataccaccttttcttttttttttttttttttttcctttcttttgtcttttttttttttaaatgcagggtcggccgggcgcgatggttcacgcctgtaatcccagcactttgggggtccgaggtgggcgtatcatggggtcaagagatcgagaccatcctggccaacatggtgaaaccccgtctctactaaaaatacaaaaaaattagctgggcgtggtggcaggcgcctgtagctccagctactcaggaggctgaggcaggagaaccgctcgaatccgggaggcggaggttgcagtaagccgagatcgcgtcattgcactccagcctgggcgacagagcgagattatctcaaaaaaaaaaaaaaaaaaaaaaaaaaaaaaggaaaaaaaaagggtcttgttctatcacccaggctggaatgcggtggtacggtcatagctcactgtaacctcaaattcctgggctcaagccatcctcccacctcaagtagctaggactacaggcgcacaccacctcacctggctaatttttttaaaaaaagttttttgtggaggctgggcgcggtggctcatgcctgtaatcccagaactttgggaggccgaggcgggcggatcacctgaggtcggaagtttgagaccagcctggccaacatggtgaaaccccgtctctactaaaaacacaaaaattatctgggcttggtggcacgcgcctgtagtcccagctactcgggaggctgaggcaggagaatcgcttgaacccgggaggcggaggtcgcagtgagctgagatcagccactgcactccagcctggcgacagagcaagactctgtctcaaaaaaaaaaaaaaaaaggttttttatagcgacagggtcttactgtgttgcccagatggatcttgagctccttgcctcaagcaatcttcccacctcagcgtctcaaagtgctgggattatgggcgtgaaccgccactcccagactactatcttattaaatatttctttttaacagttataaaaatgtttacgatcggccaggcacggtggctcacgcctgtaatcccagcactttgggaggccgaggcaggaggatcacgagggcaggaaatcgagaccaccctggctaacacggtgaaaccctgtctctactaaaaataccaaaaaaaaaaaaaaaaaaaaattagctgggcgtggtggtgggcgccttgtagacccagctactccggaggctgaggcaggagaatggcgtgaacccgggaggcggagcttgcagtgagccgagatcgcgccactgccctccagcctgggcgacagagcgagactccgtcttaaaaaaaaaaaaaaaagtgtacgatcacatgtttataagaacattctgttcttataataattgtaacagtaactcctccagaataatttttaacaactagagtcttacaatcacaagaaagatatttttcatctcaattaatatacatgtatatgcaggaagatgtaaaagattggtcaataaaggactttcaagtataaaagcataaagtttgtggggaagtggagtagtagtaggagctcaaggaaaaaagaggtgatgaaagaaaaaaggaatgattcccaactggtaagaactaatttatactttttttttttttttgagatggagtcttgctctgtcgcccaggctggagttcaatggcacaatctctgcttactgcaacctcccactcccgggtttaagcgattctcctgcctcaacctcctgagcagctgggattacaggcacacaacaccatgcccagctaattttttgtattttttgtattttttttttttagtggatatgggtttttggcatgttggccaggctggtctcaaactcctgacctcgtgatccacccaactcagcctcccaaagtgctgggattacaggcgtgaagcaccgtgcccggccatcactatgatatttcaattccactggacaataaatggtgatctaattgttttattttaaaatgtggggccaggcatggtgactcatgcctgtaatcctaccactttgggaggccgaggcgggcagatcacttgaggtcaggagttcgagaccagcctgaccaacatgaggaaacctcgtctctactagagatacaaaaaatagccaggcgtggtcgtgggcgcctgtaatcccagctatttgggagctgaggcaggggaatcccttgaatttgggaggcaaaagttgcagtgagccaagatcacgccactgcactccagcctgggcgatagagcaagactctgtctcaaaaaataaaaaaataggccgggcgtggtggctcaaacctgtaatcccagcactttgggaggccgaggcaggcagatcacctgaggtcaggagttcgagaccagcctgcccaacatgatgaaaccccgtctctactaaaattacaaaaaaattagctgggtgtagtggcgggcgcctgtagtcccagctatttgggaggctgaggcaggagaatcgcttgaacccgggaggcagaggttgccggaagccaagatcgcaccactacactccagcatgggcaacacagagagactgtgtctcaaaaaaataaataaataggccaggtgcagtggctcatgctgtaattccagcactttgggaggccgaggcaggcagatcacgaagtctaggagttcgagaccagcctggccaatatggtgacacccccgtctctactaaaaatacaaaaattagctgggcgtggtggctcgcgcctttagtcccagctacttgggaagctgaggcagaagaatcgcttgaacccaggaggcggagatttcagtgagccaagatggtgccactgcactccagcctgggtgacagagcaagactctgtctcaaaaaataaataaataaaataaaatgtggccagctgtggctcaccgcctataatcctagcactttgggaagttgaggtgggtggattgcttgatctcaggattacagaccagcctaggcaacatagtgagacctcatctcaataaatcaataaataggctgggcgcagtggctcatgcctgtaatcccagcactttgggaggctgaggtgggcggatcacttgaggtcaggagttccagaccagccttgccaacatgatgaaaccttgtctctactaaaaatacaaaaattagctgggcacggtggcacacacctgtagtcccagctatttgggggcctgaggcaggagaatcgctagaatctgggaagtggaggcaggctgcagtgagcagagatcactgccactgcactccagcctgggcaacaggagactctgtcacaaaaaaaaaaaaaaaaaaagagttcaagaccagcgtggccaacatggtgaaatccccatctctactaaaaatataaaaattaggggtgctggtgcacacctgtggtcccagctactcaggaggctgtggcaggagaattgcttgaaccccagaggcagaggttgcagtgagccgagattgcaccactgcactgcagcctgggcgacagagcaagactccatctcaaaaaaaaaataaaaattaaaaaataaataaaatgtgaatattttcaatatgccagaattacatccttgaaacaatttttatttatttatttttatttttatttatttatttatttatttttggaaggagtctcgctctgtcacccaggccggagtgcaatggtgcgatctcggctcactgcaactgcctcccgggttcaagcaattctcctgcctcagcctctgagtagctgaggcagagaatcaggtgcccaccaactttcccggctaatttttgtatttttagtagacatggggtttcaccatatttgccagactggtcttgaactcctgactttaggtgatccccctgccttggcctcccaaatttctgggattacaggcatgagccactgtgcccggccacaattttaatttatgatgaaaatttttagatacctacttaaagatatatgaaggagtatatacttcttcaaaattatttccctgagtataggtgcagaatttaagactgctgccctggccgggcgcagtggctcacacctgtaatcccagcgctttgggaggccaaggcaggcagatacctgaggtcggagttggagacctgcctgactaacatggagaaaccttgtctctactaaaaatacaaaattagcagggggcggtggcgcatgcctgtaatcccagctactcaggaggctgaggcaggagaatcccttgaaccctggaggcagaggttgcagtgagccaagattgtgccattgcactccagcctaggtaacaagagcaaaactccatctcaaaaaaaaaaaaaaaaaaaaaaagactgctgccctaagctatccaagcatctcctccatagcccccaacactcccatttccctcctgtctcccctctcacctccttggtggggaaagaagatgtttataggaaaggtggtcacaattccagctcctcctccttctgaggtgtccccaggagccagtcccctaactttgcccatagtagtaaccacagcagcttataagcagcctccagcatcagcagtgtcaggaagagggccaggaagataaagaaagccttgtccaaggcacgtcgcacgggacccctgggaggggagggaccctgggcaaatgccaggaacacatccgcctcgtccacatcaccttcctctgccatcctgactcacagtcagacagctggctggatcagggggctgggatgcaaggccttgctcagcactgccaggattaaggagcatggctgtggcaagtcctgcacctgccagtcctgaccttaattcccacacctaagagaaaagagaaaggaccctatgagccttcagatcaattatttaaacatccagtgtgatgtgaaaggtctggactaaatgatccatgaactctattcagctttttcatagtataattctgtgatttggaaactgaaggcccaacatgaaggcataagctagaactgcctgtcactctgggtctcaagtctcaaagactcaaggctcaaaatcttgggccccaactgatagagagtgaggaaatggacctaccatgcatctgtgagccatggtcagtcaaggatctaaagccccttctggctggatggtagggggtgagatggtctatcctaaccaaggcgggtaggaacaagcagaggggacttgagttctcacaggagtagttctccccactgggtctgcaggcagctaagtttgagatggtataacccagaacactctcttcctaacttttggtctctgcagtaccaagggaggattatcattgactgcatgagcccaaggggaggcttataaaaagacaaagaccgtgatggatcagcagggcaagggtatgtgattgggacttggctgttgggttggggttattttactttactttacttatttatttacagacggagtctcgctctgtctcccaggctggagtgcagtggcacgatttcggctcactgcaacctctgtctcctgggttcaagaaattctccttcctcaacctcccaagtagctgggactacaggcatgtgccaccatgtccggctaatttttttgtatttttagtagagacggggtttcaccatgttggtcaagctggtctggaactcctgacctcaaatgatccacccaccttggcctcccaaagtgctgagattacaggtgtgagccactgcacccagccagggtaattttaaagaagagtgaagttttgccatcgatggtccaggtctcagaggctaccagtggaggatgtggttgaggaggttgtaggagcaaggactgaagaccttttcttttctttcttttttttttttttttttgactgattgaagaccttttcttaggccaggcgtggtggctcacgcctgtaattccagcactttgggagcccgaggcggatggatcaattgaggtcaggagatcaagaccagcctggccaacatggtgaaacactgtttctacctaaaatacaaaaattatccgggagtggtggcgcatgcctgtaatcccagctactcgggaagctgatgcaggagaatctcttgaaactgggaggcggaggttgccatgagctaagatcatgccactgcaactgcactccaacctgggtgacagagtgagactccgtctcaaaaaaataaaaataaaaaaagaagatgttttattgaccctgttccccaggcattggcctgaaggttgggtaatgaaattgaagcccatctggaaacaagggattcgcccaagtgaggctgagggaggggagggggaacggtggaggaagcagtgtgtgtagtagtgaaccttatactgggaacctttggagcctcctacctaaactatttcattttcattttcacctcaataggaagatcttgttccttttttttttttttttaaccggatcttttttttttttgagatggagtctcgccctgtcccccgggctggggtgcaatggcacgatctcggctcactgcaacctccgcctcccgggttcaaaccattctcctgcctcagcctcccaagtcgctggaattacaggtacgtgccaccacgcctggctaattttttgtacctttagtagagacggggtttcacagtgtaggccaggctggtctcgaactcctgacctcgtgatccacccacctcagcctcccaaagtgctgggattacaggcataagccaccgcacccgggctacaggatcttgctctgtcacccaggctggagtgtagtggctcaaacgtggcccactgcagccttgatctccccagctcaagcaatcctcccatcttagcctcctgagtagttgggaccacaggtgtgtgtcaccacgcctggctcatttttgaattttgtagagacagggtctttctatgttacccaggctggtttttaactcctgagcttattaaacaatccttccacctcagcctcccatcattctggaattacaagcataagccaccatgcctaagaataccttctttacttgggaagtcaggtcaccccccaaaagagcagaaatgatgttataatgttgttttgagggctgggcgcggtggctcacgcctgtaatcccagcactttgggaggccgaggtgggcggatcacaaggtcaggagattgaggccatcctggcaaacacggtgaaaccccgtctctactaaaaatacaaaaaattaggccaggcgcggtggctcacgcctgtaatcccagcactttgggaggccgaggcggacagatcacgaggtcaggagatcgagaccatcctggctaacacggtgaaaccccgtctctactaaaaatacaaaaaattagccaggtgtgatggcgggtgcctgtagtcccagccacttgggaggctgaggcaggagaatcacttgaacccgggaggcagagtttgcagtgagccaagatcatgccactgcactccagattgggcgatacagtgagactccgtctcaaaaaaaaaaaaaaaatacaaaaaattagccggctgtggtggcgggagcctgtagtcctaactactcgggaggctgaggcaggagaatggcatgaaccccagaggcggagcttgcagtgagccgagattgctccactgcactccagcctgggcgacagagcgagactctgtctcaaaaaaaaaatgttgtttcaagtcatgccgcattgtcttttgctgcagctgcaaaggagtctcgaaaaagtgaaaaaaccctggactagaatttaaactgatcacttagttgtgtgaagctgtggacaagtcacatgacctttctttagtgttttgttttgtaataaaatcagaaaaagctcttgcctcccagaattattctgagagataaatgaaataaaggttttttgatgttgttggttttttgtaaattataaagcactatgtaaatgtaacatattaatctgataccctcacttacatcccaggcaagtgtgcaataaggccacacaaacacctttattgtctctttacatggtaggttcagcaccaacatcttgtgtaataaataaacctagcatcttgttggaatttttttaattttgaaataattttcagcttacagaaaaatttaagaacagttccaagaactttggcatgtacctctttcactcagattttccatttgtcaacacttggctgtatttgttccatctcgctctcaaccccagtataaccatgtgttacaggttgaattgtgtctcctaaaaattcatatgttgtgcagccataaaaatgaataagggctgggctgggcgcagtgtctcatgcctgtaatcccagcactttgggagaccgaggcgggcagatcacaagttcaagagatcgagaccatcctggttaacacactgaaagcccatctctactaaaaatacaaaaaactagccgggtgtggtggtgggcgcctgtagtcctagctactcaggaggctgaggcaggggaatggcttgaacccgggaggcggaggttgtggagagctgagatcgcaccactgcactccagtctggcaacagagtgagttgttgccaaaaaaaaaaagaaaaaagaacaagatcaggccaggcgcggtggcttatgcctgtaatcccagaactttgagaggccaaggtgggcagatcacaaggtcaggagtttgagactagcctggccaacatggcaaaaacccatatctactaaaaatacaaaaattagctgggcatggtggcaggcccctataattccagctagtgacatgggaggctgaggcaggagaatcacttgaacccagggggccgaggttgcagtaagctgtgatctcaccattgcactccagccccactgacagtacgagactcctctcaaaaaaaaaaaaaaaaaaaaaaaggtgaagaattcatttgttcgcatgttctcacttacaagtgatgatgagaatacacggacacacggtgggaaacaacacaactgggtcctgtctgggggagtgggggaaggaagggcaccaggaagaatagctaatggatgctgggcttaatacctgggtgatgggatgatctgtgcagcaaatcaccattgcacacgtttacctatgtaacaaacctacacatcgcacacatgtacccctgaacttaaaataaaagtcgaaggaaaaaaataaaatttatataatgaagtcctaactcccagttcctcagaatgtaaccttatttggaaataaggttgttgcatatgtaattggttcaatgaggtcatactggagttgagtgggcctctcaccccctttataagaaaggaagtttggacataggcttgcggatagagagaatgacatgtgaccatgaaggcagagatcaggttgatatgtcaaagattgccagcaggccaggcaccatggcttatgcctgtaatcccagcactttgggaggccaacacaggtggatcacctgaggtcaggagttcgagaccagcctggccaacatagtgaaatcccatctctactaaaaatacaaaaaattggccgagcacaatggctcacgcctgtaatcccagcactttgggaggctgaggcgggcagatcacgaggtcaggagttcaagaccagcctggtcaacatggtgaaaccctgcctctactaaaaatacaaaaattggcagggcatggtcatgggcacctgtaattccagctattctggaggcaggagaattgcttgaacctggaggcggaggttgcagtgagctgagatcgtgtcactgcactccagcctgggcgacagagcgagactctgtttcagaaaaaaaaaaaaaaaaaaatacaaaatgttagccgggcgtggtcgtgggtgcctgtaatcccagctactcaatcgggaggctgaggcaggaaaattgcttgaacctgggaggcagaggttgcactgagccgagatcttgccattgcactccagcctgggtgacagagcaagattccgtctcaaaacacacacacacacacacacacacacacaaaagactgccagcaaaccaccggaaactagtagaaaggcctggaacagattctcccttacacccctcagaaagaaccaaccctgcctacaccttgatctcagacttccagcctccagaactgtaaggcaatacatttctgctgtttaagtctcccagtttgtgatactttgttatggcagccctagcaaactaaaacaccattctaatcaggaaatcaatatcactcttcaattcatagatcccattcagatttcaccagctgtcccagtaatgaccgcctcttcttttttaaattatcttttttttttttttttttttggagacaggtctgtcacccaggctggagtgcagtggtgcgatctcggtgcactacaacctccaccttccgggttcaaacaattctcctgcctcagcctcccaagtagctgggactataggcacacgccgccacagccagctaattttttgtattttagcagagacggggtttcgccatgttgttcaggctggtcttgaactcctgagctcaggcaatccacccgcctaggcctcccaaagtgcaattatcttttcttttaacagctgtttttttctttttctttttttttttttttgagatgaggtctcactctgttgcccaggccaaagtgcagtggtgctatcaagagctcactgcagcctcaaactcctgggctcaagtgatcctcccacctgagccttccaaagtgctgggactacagatgcgtgccaccatacttggcctatctgtcctttctagtccaggatcacatactgcatttgactgtcacatatctatctgtagtctccttcaatctgggaagttctcagtctttccttgtctctcatgaatttgacagttttgaagaggtctttcatttctttcttttttttcttttcttttctttttttttttaaacaggttcttgctctgtcgcccaggctagagtgcagtagcaggatcatagctcactgcagcctcaaattcctcggctcaagcaatcctcccacctcagcattctgagtagctgcggctacaggtgtgtgccagcacatccggggaatttaaacattatttgtaggctgggcacagtggctcatgcctgtaatcccagcactttgggatgccgaggcaggcagatcacaaggtcaggagtttgagaccagcctggccagcgtggtgaaaccccatctctactaaaactccaaaaaattagccaggcatggtggcacatgcctgtaatcccagctagctacacaggaggctgaggcaggagaattgcgtgaaaccgggaggcagaggtcacagtgagccgagattgtgccaatatgctccaccctgggagtcagagcaaaactccatcacaagaaaaaaaaaaaaaaagacaggactttctacttgctagcctctctattgctggctttgatgatgtaagatgccatattggagaaacccacatggcaagaaactaggtgtggtctccaaacactaaccaacagggaactgagaccctcagtcaaaaaaccctttagaaactgaatcctgcaaacagctatgtgagtgagcttagaagcagaaccttccccagttaagctttatttttatttttatttttatttttattttttttgagacagagtcttgctccgtcacccaggctagagtgcaatgtgctatctcgcctcattgcaacctccacctcccaggttcaatcgattctcctgcctcagcctcccaagtagctgggattacaggtgcccgccacaacacccagctaatttctgtatttttagtagaaaccgggtttcaccaggtgggccaggctggtctggaactcctgacctcaggtgatgcacctgcctcagccttccaaagtgctgggattacatgcatgagccactgagcccggccctgagctttcagatgagatcacaggcaactcatagactgcagtcttatgagagcctccgaagcagaggatccagctaagctgttcccagatttctcccccacagaagccatcagataacagtgtgttgttttgagccaccgggttttggggtaatttgttacacagcaatagataactcatacactgtgctagaattgagcaccagatcttcagtaacagatacacccatatattccttccaaatttattcttttaacatttatgatatgtggggccttctgaaatgtggggctccaggcaggatctcctcttgcttggatataagagcagcactagaattagtctatcagtcttcacattttcttgcttgcatgctccttaaaaacattttggaaaattatgtgccattttgtatatatttttatttggcatctaatttttttccttgttgatttaaataactgcaaagagtataacaaatcggcttggtgcaatggctcacacctgtaatcccagtactttgggaggccgaggcaggtggataacgaggtcaggagttcaagaccagcctggctaacatagtgaaaccctgtctgtactaaaaatacaaaaattagctgggcatggtggcgtatgcctgtaatcccagctactcgggaggctgaagcacaagaattgcttgaacctgggaggcggtggttgcagtgagccgatatcataccactgcattccagcctgggcaacagagcgagactccatctcagaaaaaaaaaaagagtgtaacagatcttgtgtcttatataaatattgacattgtaaaataaaactgtcaactgggcacggtggctcacgcctgtaattctagcactttgggaggccgaggcaggcggatcacgaggtcaagggatcgagaccagcctggccaacatggtgaaaccccatctctactaaaaatacaaaaattagctgggcgtggtggcacgcgcctgtagtcccagctaatgaggaggctgaggcaggagaatagcttgaacccaggaggaggaggttgcagtgagctaagatcacaccactgcactccagcctggctgacagagccaaactccatctcaaaaaaacaaaaacaggctgggtgcggtggctcacgcttgtaatcacagcactatgggaggccgagacaggcggatcacgaggtcaggagatcgagacaatcctgactaacacggtgaaaccccgtctctactaaaaatacaaaaaaattagccgggcatagtggcgggcgcctgtagtcccagctactcgggaggctgaggcagaatggcgtgaacctgggaggcggagcttgcagtgagccaagatcgcgccactgcactccagcctgggcaacagagccaggctccatctcaaaaaaacaaacaaaacaaaaacaacaaaaaaaaacaaaaaactgtctggctgggtgcagtggctcacgcctgtaatcctagcactttgggaggctgaggtgagtggatcacctgaggtcaggagttcagaccaatctggccaacatagtgaaaccttgtctctaccaaaaatacaaaaattagccaggcatggtggcacatgcctgtaatcccagctactcccgggttcaagcaattcttgtgcctcagcctcccaagtagatgggattacaggtgtgcaccaccacacacctggctaatatttttgtatttttagtagagatggggtttcaccatgttggctaggctggtctggaactcctgacctcaggtaatctgctcgcctcagcctcccaaaatgctgggattacaggcatgagccaccacacctggccacaaaataaataaggaaataaataaatatatatatgtaaaatatatatatgtaatatatgtaaaatatatatgttatatatgtaaatatatatatatatacacacatatagtttgtttgtttttgagatggagttttgctcttgttgcccaggctggagtgcaatggcacgatcttggctcactgcaacctccgcctcccgggttcaagcgattctcctgcctcagcctcctgagtagctgggaatacaggcatgcaccaccacgcctggataattttttatttttagtagagattgggtttctccatattggtcaggctggtctcgaactcctgacctcaggtgatccacccacctcggcctcccaaagtgctgagattataggtgtgagccactgcacccagcccgctctgtcttaaatatgagtgcccagttaaggaacaccagatatttgaggaagacttcagacatgagcaaaaacccaaaattaaaagtaaaaacgacacagcattgtgctcttcgccttccctcatcgtctggcgcagggcagcccacttctggtgtttggcgctggaattaaacaaccaccatgtggagcaaaaaggcaagaccaagaccaccaaaaagctccctcagcgcacaacatccaacgtgtttgccatgtttgaccagtcacagattcaggagttcaaagaggccttcaacatgattgatcagaacagagatggtttcatcaacaaagaagatttgcatgatatgcttgtttccctagggaagaatcccaccgatgcataccttgatgccataatgaatgaggcaccagggcccatcgatttcaccatgttcctcaccatatttggtgagaagttaaatggcacagatcctgaagatgtcattggaaatgcttttgcttgctttgatgaagaagcaacaggcattattcaggaagattacctgagagagctgctgataaccatgtgggatcggtttacggatgaggaagtggatgagctgtacagagaagcgcctattaacaaaaaggggaatttcaattacatcgagttcacatgcatcctgaaacatggagcaaaagacaaagacgactgaaaagaactttagctaaaaccttccaactacattgtcttactctgttttatttctcagacacttcccccatcctcatagaacctgttgcatgcaacttagtttcacagctttgcctcttttttttttttatgtatttattccagacctttctgtcacacagcacttgtataatcagactgaaaatggggatgagggtgtaaattgtattgaaaaagagatcatggccgggcgcagtggctcacgcctgtaatcccagcaacttgggaggccgaggcgggtggataacctgaggtcaggcgttcaagaccacgctgaccaacatggtgaaaccccgtctctactaaaaatacaaaaagttagttgggcgtggtggcgggcacctgtaatcccagctactcaggaggctgaggcaggagaatcgcttgaacccaggaggcagaagttgcagtgaaccaagatcacaccgttgcaccccagcctgggcaacaagagcaaaattcagtcaaaaaaaaaaaaaagaaagaaagaaaagaaaagaaggccaggcacggtggctcacgcctgtaatcccagcactttgggaggctgaggcgggtggatcacgaggtcaggagatcgagaccatcctggctaacacggtgaaaccccgtctctactaaaaatacaaaaacattagtcaggcatggtggtgggctcctgttgtcccagctactcgggaggctgaggcaggagaatggcatgaagccaggaggcagagcttgcagtgagccgagattgagccactgcactccggcctgggcgacagagtgagactccgtctcaaaaaaaaaaaaaaagaaaagaagaaaaagaaaaagtgatagcaaataaaaatcaacaaatgtgaaaaaaaaaaagtaaaaacaaacatggaggaaagagacagaagaggaaaacttcatataaactataataaatttccacactgatgagagaaaatgagtatcagaagaagaagaagagttgtaagatcaacaggatatgagaaatgaaaacttgagccaggtgcagtggctcacacctgtaatcccagcactttgggaggctgaggcagccagatcacttgaggtcaggagttcaagaccagcctggccaacatggtgaaaccctgtctctactaaaaacacgaaaattagtcgggtgtggtcatgggtgcctgtaatcccagctatgcaggaggctgaggcaggagaatcgcttgagcctgggaggcggtggttgcagtgagccgagatcgcaccactgcactctagcctgggtgacagagtgagactccatctcaaaaaaaaaaaagaagaaaaaagaaaaaaaaacttgaacccaattataagatctagattttggccaggtgcggtagctcatgcctgtaatctcaacacttaagaggctgaggtaggaggattgcttgagcccagacatttgagaccaacctgggtaacatagggagacttgtctctacaaataatttaaaaattaacaggcagggcgcagtggctcatgcctgtaatcccagcactttgggaggccagggcaggcagatcatgtgaggtcaggagttcgagaccagcatgaccaaaatggtgaaaccccatctctactaaaaatacaaaaaaaaattagcggggcatggtggctcgcacctgtaatcccagctacttgggaggctgagacaggggaattatttgaacccagcaggtggaagttgcagtgagccaagatcgcaccattgcattccagcctgtgtgacagaaagactctgtctcaagaggaaaaaaaaaaacattagccagggccggtcgcggtggttcatgcctgtattcccagcactttgggatcccaaggtgggcagatcacttgaggttaggaattcgagaccagcctgaccaacatgatgaaaccccgtccctactaaaaatacaaaaaaattagctgggtgtggtggtgcatgcctgtaatcccagttactcgtgaggctaaggcaggagaattgcttgaacttcggagattttgcagtgagccaagattgggccacttgcactccagcctgggtgacaaagcaagacttcctctcaaaaaaaagaaatccatggccgggcgcagtggctcacgcctgtaatcccagcactttgggaggccgagatgggtggatcacgaggtcaggagatctagaccatcccggctaacatggtgaaaccccatttccactaaaaatacaaaaaattagccaggcatggtggcgggcacctctagtcccagctacttgggaggctgaggcaagagaatggtgtgaatccgggaggcggagcttgcagtgagccgagattgtgccactgcactccagcctggacaacagggagagactctgtcaaaaaaaaaaaaaaaaaaagaaatctcaaaaaagaaagaaaaatggccaggcacagtggctcatgcctgtaatcccagcagtttgggaggctgaggtgggcacatcaacttaggtcaggagttcgagactagcatgatcaacatggtgaactctgtctctactaaaaatacaaaattagcctgatgtagtggcacatgcctctagtcccagctactcaggaggctgagacaggagaatcacttgacaggaggcagaggttctggtgagctgagatcacaccattgcactccaacctgggcaacaagagtgaaaccccagtttaaaaaaaaaaggaaaaaaaaagaaaaaaaaaaaaccacggtagcgtgcacctgtgtttccagctattcaggaggctgaggcaggaggatcatctgacctggaggtcaaggctgcagtgagccatgatcacaccactgcactccagcttgggcaacatagtgagactctgtcacgaagcctgcagtgcagtgacgagatcttggctcactgcaatctctgcatctcaggttcaaatgattctctgcctcagcctcccaagtagctgggatttactggcatttgccaccatgcctggctagtttttgaatttttttagtagagacagtgttttgccatgttggccaggctggtctgtacctaattttgtatttatacttttggttttttttttttttttgagacggagtctcgttctgttgccctggctggagtgcagtggcgtgatctcagctcactgcaacctccgcctcctgggttcaagcgattctcctgcctcagcctcctgagtaactgggattataggcactcaccaccgtgcctggctaatttttatatttttttttagtaaagatggggtttggccatgttggccaagctggtctcaaactcctgacttcaggtgatctgcccacctcggcctcccaaagtgctgggatacttttggtattctttctcttaaaacaggtatccaaaattgtacacgtgtcagcctcccaccaacctacatctgctgcacttgcagagatagagtctatatatataagcatgtattaatatatataagtgtatatgtataaatgtatacatacatataaatacatgatcactactcttttccttgcttttcctcacttaataccttgaaatcaaacagagaggtgcttccttctttttttttttcggagtcggagtcttgttctgttgcccaggctggagtgcagtggcccaatctcggctcactgcaaccttcacctcacaggtttaagtttttcttctgcctcagcctcccaagtaacttggactacaggcgcacaccaccatgcctggctaatttttgtatttttagtagagatggggtttcaccatattggccaggctggtctcgaactcctgacctcatgatccttctgacttggcctcccaaagtgctgagattacaggcttgagccaccacgcccagcctctttttttttttttttttttaaatttaatttaatggagatgagttctctcaatatgttacccagagtagtctcaaattcttgggctcaagtgatccacctaccttggcctcccaaagtgctgggattataggagtgagccaccgcacccgaccccttgtttgttatagtgctcccttgactctcaaaaatgtccagtgtaggccaggcgtggtggttcacacctataatcccagcactttgggaggccaaggcaggtggatcacttgaggtcaggagtttaagacttgccgggctaacatggtaaaaccctgtctacaaaaaatacaaaaattagctgtgcgtggtggtgcgcacctgtaatcccagctactcaggaggctgactgaggcaggaagactgcttgaacctgggaggcagaggcggaggttgtagtgagctgagattgtgccaccgcactctagagcaagactccatctcaaaaaaaaaatgtctagtgtaaatgtatgttctttgaagtagaattgctaggtcaaagaatacgtaaatacttgatttgggtagatatttttaaaatgctttctgtagaagccgcaccagtgtaccttccttcctgtcggcaatgtgtgacagtaccagtttcctttccccaccccatcagctgagtgtgttatcaaactttttttttttttttttttttgagacagagtctctctccatcgctcagcctggagtgcagtggcatgatctcggctcaatgcaacctccacctcctaggttcaagccattctcatgcctcagccaatagctgtgattacaggtgcatgccaccaccggctgatttctgtatttttagtagagacagggttttgccatgtttttttgtttgttttgagacaggatctttctctgttgcccaggctagagtgcagtggcatgaacatggatggttcactgcagcctcgacctcctgggttcaagtgatccttttgtctcagcctcccaagtagctgggattccaggtgggagccaccatgccctcctaaactctaccttttggtgagagtgactagccaccaaggcacactgtaaaggcctcagataacaggaagtggtagagaactgcagccaatctaacacctagacaaattcaaggtgggacctatcaggtactatgcttgttacttgggtgattaaattacctgtacaccaaagccccatgacacacactttacctatataaggaacctacacatgtacccctgaacctaaagtaaaagttaaaaaataaaataatataattcaaagtttgggctacagagtataagtgagagatattcagctactgggagtttataaaagacacacaaacatcgcacaagagcaaaagtcaatttgaacatccaccacagccagaggaaaccaaaaccacttccagtgtatggccgtcaggtaaagcattttgtccccctcacctcctctgcttctggctgtgagggagagggtggagagtcagacacaggaaggcaagaaagaaattcttgaggaagccagccactctgccagtttcacactggcagcttcccatgtcaaaccactcagtcggagctggccgagagaaaaaacgtaattcagaatgatgcttggaggatttttttttttgttccaaggattgagcaggtatgctctgtggcctgcctgagttatctttcatgggcaatggaagaactagccccacacaacatatttaaaggggtggggacacttgagtgtggggggtgcacagcaacatattcaagcttatgtacatggcatctgaggtcggggcatggaagaatactgaggcactgtgtgtatgttatttgtgcgtgagaatgaaattccttgaccctgaaaacaggacagggagtggagtgtgtggtgtgataaggaacgctgaaaacagcctcctgagaatgcggtttgagtgcttttacgaggccgcaggtgtctcacgacccgacctcaaaaagccatctagtggatgtttgtggtttaacaagcactttcaataaatacttggcagacggatgctggggcgggttctcttagaagaaatgccccccccattcccccggccccactcagctggaattgtctaagaactcattcttggcgttcactgcaagctataaactctgcaagtggtgcacccgacgtgatcgccttgaagttatgcgtgaaaggaggagagctcatcaattttaagaaaatcccggtaagggacagtcctgactaccatcaggtggacaggacccacgcgaaaaataccaggggttcggttatcatgggtcaggaaatgaacaaagaataatttttttttttttttgagatggagtctcactctgtcgcccaggctggagtgcagtagcgtgatcccggctcactgcaacctccacctccctggttcaagctattctcctgcctcagcctcctgaatagctgggattacaggtgcacgtcaccccacaacaggacttaattaaccttgccttcaaggtgtacaataatagagaaaagttacaattacttgcctctgctgtgagacaaaacccagctgcacctccagcacacgagaacttcaaaatgcctaagccgcacatgcctaaaccgcagtggtcaagcattcctacaggaccttcttcatcaggatcttgcttcaagtgccagaaatctggccactgggccaagaaatgcccacagcccgggattcctcctaagccgtgtcccatctgtgcaggaccccactgaaaatcagactgtcccactcgcctcgcagtcactcccagagctctgggatctctggcccaagactctctgactgactccttcccagatcttctcagcttagcggctgaagactgatgctgtctgatcaccttcgaagcctcccgggccatcacggacactttgggtaactcttacagtggagggtaagtcacccttcttaatcaatatggaggctaccaactccacattaccttcttttcaaaggcctatttcctttgcctccataactgttgtgggtattcatggccaggcttctaaacctcttaaaactccccaactctggtgccaacttggacaatattcttttatgcactcctttttagttatccccacctgcccagctcccttattaggtcgagacattttaactaaattatctgcttccctgactaatcctaggctacagccacatttcgttgctgcccttttccccagttcaaagcctccttcacgtccttctcttttatctcctcaccttaatccacaggtatgggacacctctactccctccctggtgaactatccacgcccattactatcccattaaaacctaatcacccttaccccgctcaatgccagtatcccatcccacagcatgctttaaaaggattaaatcctgttatcactcacctgttacagcatggccttttaaagcctataaactctccttacaattcccccattttacctgtccaaaaaccagataagccttacaggttagttcaggatctgcgccatatcgaccaaattgttttgcctatccaccctgtggtgccaaacccatatactctcctatcctcaatacctccctccacaacccattattctgttctagataaacctagctgaccccatagatcctaaatcctttctcctctcccctttccattccttaaaacacagctcccacactagctctccatgactcatcccgacccttttcattacacacagccgaagtgcagggctgtacagtcagaattcttacacaaggaccaggaccgcaccctgtagcctttttgtccaaacaacttgacttactgttttaggctggccatcatgtctccgtgcagtggctgccactgccctaatacttttacaggccctcaaaatcacaaactatgctcaactcactctctacagttctcataaatctattttcttcctcacatctaacacgtatactttctgctccccggctccttcagctgtactcattctttgttgagtctcccacagttaccattgttcctggccaggacttcaatccagcctcccacattattcctgataccacacctgacccccatgactgtatctctctgatccacctgacattcaccccatttccccgtatttccttctttcctgttcctcaccctgatcacacttggtttattgatggtagttctaccaggcctaattgccacacaccagcaaaggcaggctatgctatagtatcttccacatctatcattgaggctactgctctgcccctctccactacctctcagcaagctgaactcattgccttaactcgagccctcacttttgcaaagggactacatgtcaatatttatacaactctaaatatgccttccatatcctgcaccaccatattgttatatgggcaaaaagaggtttcctcactacgcaagggtcctctgtcattaatgcctctttaataaaaactcttctcaaggccgctttacttccaaaggaagctggagtcatttactccaagggccatcaaaaggcgtcagatcccatcgctcagggcaatgcttttgctgataaggtagctaaagaagcagctagcattccaaattctgtccctcacggccaatttttctcattctcatgggtcactcccacctactctcctgctgaaacttctacctatcagtctcttcccacacaaggcaaatggttcttggaccaaggaaaatatctcctaacagcctcacaggcccattctattctgctgtcatttcataacctcttccatgtaagttacaagctgctagcccacctcttagaacctctcatttcctttccatcgtggaaatctatcctcaaggaaatcacttcttagtgttccatctgctattctactactcctcagggagtgttcaggctccctcccctccctacacatcaagctcagggatttgcccctgcccaggactggcaaattgactttactcacatgccccaagtcaggaaactaaaatacctcttggtctgggtagacactttcactggatgggtagaggcctttccaacagggtctgagaaggccactgcggtcatttcttcccttctgtcagacataattcctcgctttggccttcccacctctatacagtccaataacagactggcctttattagtcaaatcacccaagcagtttctcaggctcttggtattcagtggaaccttcataccccttaccatcctcaatcttcagaaaaagtaaaacagactaatagtcttttaaagacacacctcaccaagctcagcctccaacttaaaaagactggacagtacttttaccacttgcccttctcagaattcgggcctgtcctcggaatgctgcaggatacagcccatttgagctcctgtatggatgctcctttttattaggccccagtcttattccagacaccagcccaactcggactgcaccccaaaaacttgtcatcccttctatcttctgtctagtcatactcctattcaccattctcaactactcataaatgccctgctcttgtttacactgccggtttacactgtttctccaagccgtcacagctggtatctcctggtgctatccccagaccgccactcttaactccctcttaaagtaaataaataatatttgctggcagggcacactccaatactttcaccctgatgaagtcctattctttacttttatactcactcctattcttgttcccatttttatgccaccctctacctctccccagctagctccaccacactatcaatctcattcactctctcctagccgtttctaatccctcatcaaaccattgctgaatttgcatttccctttcttcctgcgcctacacagctgtccccgccttacatacagactgggcaacctctcctatctccctacacctccaaacttcctttaacagccctcacctttaccttcctaaagaacttctttactttctagacaggtccagcaagacttccccagacatttcacttcagcaagctgccgccctcctccacacttacttaaaaaacctttctccttatatcaactctactccccccatatttggacccctcacaacacaaactactattcctgtggccgttcctttatgtatctctcggcaaagacccactggaattcccctaggtaatctttcaccttctcgatgttcctttactcttcatctccgaagcccaactacacacatcactgaaacaattggagcctcccagctctgtattacagataagccctctatcaatactggcaaacttaaacacattagcagttattattgcttaggaagacacttaccctgtatttcactccatccttggctaccttccccttgcttgtcagactctcctcccaggccctcttcttgtttgcttatactcagccccgtaaataacagtgaaaggttgctcgtagacactcaaagttttctcatacaccatgaaaatcaaacctccccctctacgtagttaccccatcagtccccattacaacctctgacggctgccgccctagctggatccctaggagtctgggtacaagacacctctttcagcactccttctcatctttttactttgcatttccggttttgctccgcacaaggtctcttcttcctctgtggatcctctacctacatgtgtctacctgctaattggacaggcacatgcacactagttttccttactcccaaaatcaatttgcaaatgggactgaacatcttcctgttcccctcatgacaccgacacaacaaaaaagagttattccgctaattcccttgcttgtcggtttaggactttctgcctccactattgctctcggtactggaatagtaggcatttcaacctctgtcacgaccttccatagcctctctaatgacttctctgctagcatcacacacatatcacaaactttatcagtccttcaggcccaagttgactctttagctgcagttgtcctccaaaaccaccgaggccttgacttactcactgctgaaaaaggaggactctgtatattttttaatgaagagtgttgtttttacctaaatcaatctggcctggtgtatgacaacataaaagaactcaaggatagaggccaaaaactcgccaaccaagcaagtaattactctgaacccccttgggcactctctaattggatgtcctgggtgctcccaattcttagtcctttaatacctgtttttctccttcccttattcggaccttgtatcttccgtttagtctctcaattcatccaaaactgtatccaggccatcgccaatcattgtatacgacaaatgctccttctgggattacaggcgtgagacaccgtgcccagccattttttttttcctaaagatgataaccattcttttccagctgtcttttcttttttttttttttttttttgagacagagtctcactctgtcacccaggctggagtgcagtggcgcgatctcagctcattgcaacctccacctcctggggttcaagcaattctcccacctcagcctcctgagtagctaggattacaggcacccgccatcatgtccggctaatttttgtttttttttttttttggagagatggggtttcaccatgtcagctaggctggtcttgaactcctgaccttaggtgatccgcccgcctcagcctcccaaagtgctgggattataggcgtcagccaccacaccgggcaacaaatgctccttctaacaaccccacaatatcaccccttaccacaaaatcttccttcagcttaatatctcccactctaggctcccacaccgcccctaatcccgctcgaagaagccctgagaaacatcacccattatctctccataccacctccaaaaattttcgcagccccaacacttcaccactattttgtttattaatataaggagataggaatgtcaggcctctgagcccaagttaagccatcatatcccctgtgacctgcaggtatacatccagatggcctgaagcaattaaagatccacaaaagaagtgaaaatagcctcaactgatgacattccaccattgtgatttgttcctgtcccaccctaactgataaatatattctcccccacccttacgaaggtactttgtaatattctcccctgcccttaagaatgtagtttgtatgcctatcccaaacctataagaactaatgataatcccaccaccctttgctgactctcttttcggactcagcccgcctgcacccaggtgaaataaacagctttattgctcacacaaagcctgtttggtggtctcttcacacagacgccggtgacactattttcctaagccgtctggctagtagcccctaattgttcagctattcctctaacagcatctctagtgtagttaataaatcgctattggttgtaatagacgtagtttacccaatctacacttttattaattgttacccaccaaaatgttgacttaaatcctgcagcaatttgattttgggctttaaattgatctggtattccccatgggactcttaattgtgtctaaatagacgtgagagtcgaaagacccataaagggcttctcttgctttatgatacttatttttccttcctctcgttgatgaaataacagggtgaaagggatagccaattggaataaagcacaagtgccattccagttatttggcagtgtccagtaaagatccaccacaataccaccacacatccactcggggatgaacaagggctgactgattgataagctcttgaaaattcttaagctcactgcatccttcaggtctccaaggaatgctaagtttcctccctattgggagagacacgaagtgaacttagtgttgggagacagaagctggatggccctcgggggctgacgcgcagggtgccggacttcaggatatagcagagagagagcttggcgtgagttattactccaggctgtagaatcctggaaaagagctaccatgcagcccacacctggtcgactggaggaccaccttagtggaaaggggacaatctgggcctctggcctgccatgtgcacaagcataacaattgcttttgtttaatgtggacggaatatttgatccattccaaccaggcatttgcatcttggtatcctgtgttaattgccaaaatgttttttaagtctttaacttctatgatcctctagtaaaatgaatatatggttttaggaaattacaaaaactgattggggcagtccatacttgctctttagtgatccacagaacgttggaccgactacggcataaaagctctacattgggggtcaagaatcctggttgacattgggatctttatcgaaatccccccggattcagtggtcctaatttactaatgcccagtgtgaggagagtcaggagggacagaggtacttttcagaagtagagagctgtctttgacttggcaagttcctacgggatataacaaggcaagcactaaatgcaatagtttgaggcgaaattgacttggttatgttaataactagatggtcagcaatagagcgaggaaaggagaaagagtaatagaatagatgaaagagttaaatttttcttagctttaatttggtagggtttccccctgggactatggcccacaactctggagggggtggtgctttcttgactcgggtgtgatgaatccatccctttttcgctgtacaaactgcagtctcggtggttggcagcacaaggtagggtccttcccaggctggctcgagttttccttctttccaccctctgatgacaacatgatcttcaggctggtgctggtttaccagaaattttaggggtggtacctgtgctaaaatatttttagttttgagggagaggaaagtggaagataaaccaagcatataatttctaagaaatcgaccttttgttttaaatgtggggacatcagcagtggactttatagtccttggtgccttcttactgagaaatttcctttagcacttatttttattagtttttttagaccaaagaacgccaaacaccattttatatttgacagtgcttcctgtatgatttttataccagataagctaaatttcacctttatattagtgtgttattaatttttttttttgaaacggagtctcactctgttgcccaggctggagtgcagtggcgcgatcttggctcactgcaacctctgcctcccgggttcaagcagttctcctgcctcagcctcccaagtagctgggactacaggcacacgctgccacgcccggctaatttttttgtattttagtagagacggggtttcaccttgttgcccaggctggtcgcgaactcctgagctcaggcaatctgcccgccttggcctcccaaagtgctgggattacaagcgtgagccaccgcgcccggcctattaatgttaaacttagttttaataacactttgtagacatatttatccaatttttaatgtctgatcataaggtaagtttttgttttttgtttttttttttttttttgagatggagtcttgctctgtcgcccaggctgaaatgcagtggcacgatctcggctcactgcaagctccacctctcgggttcacgccattctcctgcctcagcctcccaagtagctgggactacaggcgcccaccaccacgcctggctaattttttgtatttttagtagagacagggttttacttgttagccagggtggtctctatctcctgacctcatgatccacccacctcggcctcccatagtgctgggattataggcgtgagccaccgtgcccggcccataaggtaagatttttatagactgtttttttttttctttttgagaaggagtttcactcttgttgcccaggctggagtgcaatggtgcaatcttggctcactgcaatctctgcctcccgggttcaaggaattctcctgtctcagcctcccaagtagctgggattacaggcatgcaccaccacacccagctaattttggatttttagcagagatgggggtttctccatgttggtcaggctggtctcgaactcccgacctcaggtgatctgcctgcctcggcctcccaaagtgctgggattacaggcatgagccactgagcctggcctgtttttaactttttataatttttgttaaacagcgggttagtgctttaagaaaaacccgttgtgtttttattttaatgctcagttcacagaaaaactgggtgatacccttttaaccttagccaatatgtttacacacataatttccattacaattaacattttaaaacttgcttaaaccttcaaaacaaattttttttttcttttttgagatggagtcccactctgtcacccaggctggagtgcaatggtgcgatcttggctcactgcaacctccgcctcccacgttcaagtgattctcctgcctcagcctcctgagtgagtagctgggattacaggtgcccaccacaacgcccagctaattttcgtatttttagttgagacggggtttcaccaggttggccaggctggtctcaaactcctgatctcaggtgatccacccacctcggcctcccaaagtgctaggtaggattacaggtgtgagccaccatgcctggccacaaaatttttttttaaccttttaatgtaggtaaaaatccacattcttatgcctccttataatccttttactaaaagtatattttactttccttatacatcttgcacataaattgtttcttcaatagttttacattcagggtaacacccctggtggcctttggaatgtgtccagacttgctggcttcttgcttctagcactcccattatctcaagtagccatacatttcaaagaaaatgctaaaccatcacatctgtagttcattagcttgatacatcgcttcctttcaacccccacatcctcaccccctgtttgtttgatcaccaataaatagtgtgggcttccagagctccgggcctttgcaacctccatactagtattggccccctggtcccactttctctctgaacttgtgttttctcattcctttgactctgctggacttcgtagcccccacggcctggtgttgggtctgatcaccccaaaaggttgatggccttttttttttttcctgcattgctgagagcttgggttattccttgcactgggtaggtcttgatttttcacgcctgaggccgccacaatagggcggggttcacctcctcaagagagagaaccagagaccacccccagaggggaatgtaatcccagacaagcccccaaattgttatatataaagtttcggtgccgcaaaaggaatatcactcaaatataaaattttccttttaattctcagcaaggctaggtacttctatatagaagggtgcacccttacagatggaacaatggtgagcgcacacttggacaagggaggggaaggggttcttatccctaatgcacgtggcccctgctgctgtttcgttcccctattggctagggttagacagcacaggctaaactaattctgactggctaatttaaagagaatgacgggatgagtgctttggcgggagtcagggcagagcaggtggcaggtgatcaaaatgagttagggtggagcaggagatcagaatgagtcagggtggagtaggtaatcaaaaaagattgctttacgaggaagttaagtttaaaagtagaaggtaaagaattgaacataatgacaattatttgaaaagaaatttagaactcatatctaataccctggaatataagaggaagttgcatgctgcctcctcggttttatcccaggtagctctagctttcttgctgcccacagaggcctggagcaggagagatgctaagatgccatggagtgcccatttggccactggcagtctgggcaggttgcccctttctgggtttgtggtgacggaggggaggccaaaaggcgcagactgagtccccaggtggctgcaggcagctccagcccagtcctgaggatcctcctcaccatggtcacctgccttagtaactgtgcccaggaagtggcctgctgcttgctgtgctgctgcttttcctacttctgcccttccctgccacccctcacatgtctcagttgacaagcaattccttgtctcccctggccccctagggaaagggctaagaaacagtccatgtacaccccgaccttactagcctaaggtgggcaaaggagtgtggagcagcctagagtacagagccctgggggaggagcccgctaataagggacgctctcctatagccatatttaaatgctagctaggctgaggtggacaagctctgccagctgctgtcatcttcagaagatagacgcagcagtaaggaatatttgttttgcttttttataaaatgtttaaaagcactgtggctaagaaacttcaggccgggcgcggtggctcatgcctgtaatcccagcactttgggaagccgaggtgggcggatcacgaggtcaggagatcgagaccatcctggctaacacggtgaaaccccgtctctaaattagcccgctgtggtggcgggcgcctgtagtcccagctactcgggaggctgaggcaggagaatgctgggagtggtggcatgcgcctgtagttccagctactctggaggtcaagatgggagtccagggcggttgaggctgcagtgagccaagatcgtgccactacaacccagcctgggcaacggagcgagaccttgtctcaaaaaattaaaataaaataaaaactcccacaaggaagaaagtagtcatctttatagagtcctctccatgtagtgttagcacaatcgctcaagaggcacccaatgtagagaaacgacggtgaggttagcagtaccaaggagcagggtttgaatcccggctcttgctcttttttttttttttttttttttttttttagtatttattgatcattcttgggtgtttctcagagagggggatgtggcagggtcataggatagtagtggagagaaggtcagcagataaacacgtgaacaaaggtctctggttttcctaggcagaagtccctgcggccctcggcagtgtttgtgtccctgggtatttgagattagggagtggtgatgactcttaagcatgctgccttcaagcatctgtttaacaaagcacatcttgcaccgcccttaatccatttaaccctgagttgacacagcacatgtttcagagagcacagggttgagggtaaggttatagattaacagcatcccaaggcagaagaatttttcttagtatagaacaaaatggtgtctcctatgtctacttctttctatgcagacacagtaacaatctgatctctctttcttttccccacatttcccccttttcttttcgacaaaaccgccatcgtcatcatggcccgttctcgatggtcgctgtctcttcagagctgttgcgtacacttcccagacagggcagcctggcagaggcgctcctcacctcccagacggggtggccgggcagaggcgcccacttcccagacggggcggccgaatcccggctctttcatgttttagctgttgggctttggggaagttattctacctctttcagcctgtgcaccctgtctcatcattaaaaaatgagaatgaggccaagtgcagtggctcatgcctgtaatcccaacgcttggggaagcggaggcaagagaattgcttgaggccaggagtttgagaccagcctgggcaacataatgagatcccaatctctgcaaaaaaatttaaaaattatctgggcatggtagcacacgcctgcagttccagctactcaggaggctgaggtgggaggatcacttgagcccaggaatttgaggctgtagtgattgctccactgcactctagcctgggtgacagaatgagaccctgcctcaaaaaaaaaaaaaaaaaagtgaaaagtgaaaatgataatacctactatgaaggattgctttaagaagaaatgagataatgtacacaaaagtacatcacatatcgcttagcatgtggctgagactcagaaaaaatcctggctttgttttcctgcattgggagtttattgttgtcaaagtgatggttccaagaagtcaaaggagagccagagaactggacagctcagcagcagttggtttgggtcaccaaatgcctctcttccctccctattgccactgacttagatcctggagatgtaaggttttaaaaacagcagcctattatcttttatttttggtaatccttgtaacctggttccctatcttaatgaaaaaaaccaatggttctggctttattacctaaagaaaggaatgacagtataataccaattataaataaatgggtcaaatttttggctttagagtttcaaagacttatggcattaaaaaaaaaaaaaagaaaaaatggaccgggcgcagtggctcacgcctgtaatcccagcactttgggaggctgacgcgggtggatcacttgcagtcaggagtttgagaccatcctggccaacatggtgaaaccccgtctctactaaaaatacaaaaattagccgggtgttgtggcacgtgcctggaatcccagctacttgggagactgaggcatgagaatcccttgaacccgggaggcagaggttgcaatgagctcactgcactccagcctgggcgacagagcaagactctgtctcaaaaaaaaaaaagaaaagaaaagaaaaaaagagaaaatgaagagttccttttctcaacactctcatcaatacatgcatgcacacacactcttgcatgcagccatgaattctcatgtgtgcatacacacattcaaaggactagataaagattctccagactttgcaatagggaagtcaggtggaagcagggagctagaatggataatgtatgaagaaactattaatgtgttttttccttttatactcttttgccttcagcaagtaaatgacctctttcttatttggttgtggcatcaaactgcttgtgaggagattaagattgtttcagaagaaatataaagagaaggaaatggtaatatgcatctattgaaattcaaaataggattttgcagcaagacaatggacttgaaaactggactatgagaaagaaattgttttctgcattcatttagctcccatttaacataatcaagagccagatctagaatcaagtttctaccaaaggaggaggtaatttaatctctcatctttgatttcctatatgtccataatgaggataataacagctacctcaacagattgtttccaaagggaacccttgtcttttgaagtggcaattagagctaggaagccaaagataagatatgaaaagaataaaagagaagcctaccacttctcatcttggagtttcaacaagacgaaggcagggaggtgagagtcaaggagatgccttggaattgggggaatggcttcagaaacatccagaaaacagaagagatcactgaagctgctacaaaattttgcccattgtagataagtgggcaaatcaggatgcactggcagggagacagggtctgttttgtgttaccagcccttttccagtgatgggtattgaattgagagccatgggcctgccatggggcatggggggtaggaagagggtgacctggcagcagaggcatgtggtttgcataacttggttaggagctgaatgggagacatggtagagattcaggggtcccactgggctaccgagagccacagggaggttgagtcagccagaaagcaccagtgagatcagatccagccaagagatccacgagaaactctaaatgttgactttagccaaaggcccccaggatgaatgtgaccaagtacatactgactcataaaccggaggagctggaggacactctgagaacccaaggacccttgctgtcctcctatacctgtccccaggagattgcttaagccactctatttattttcatgctcatgggtttgtgagttgtctgtggtttgtctaatcaggctgggcttgacagggcttggtaggactcctttagtcctggtccagtgtctattctgggtcacagctgaaggggcaatggatatctggaatttgcctttctcttgtcagatcacaggagtgcaagaggccaagccaaactacaaaagcacattgaaagcatctgcttgcatcgtgtcctctgacattctgttggcacaagcaagtcacacagcaaaggggatggatgtacacttaaataataaggaggaagcaaaggattgggaataacagtccaaaccaccacagggccctacctacccccaagaagtaatatcctcagattgatctgggaaatccaagagcagatgatgtttcccatgtgccaagaatatcagtggagtatcacacagagggccccaaaagccagcacgccaaggatgatggagcaggatgaagagaccctgggtcttagataatatcgttagggggcttactggctgctgacctccggacatttttgaaatatgaaacaattaaatgtctttattaactgacattattagctgagttttctgttgctttcatctgaatgcatcctcactgttgcaggactctatttttatttttatttatttatttatttttgagatggagtttcactcttgtcgcccaggctggagtgcaatggtgccatcttggctcactgcaacctccacctcccgagttcaagtgattctcccaccttagcctccccagtagctgggactacaggcatgtgccactatgccaggctaattttgtatttttagtggtgacaggtttcaccgtgttggccaggctagtcctgacctcaggtgatctgcccacctcgacctcccaaagtgctgggattacaggcttgagccaccacgcccagccttgttgcaggactcttattaaccctatttgtccatgagacccagagacataaaggcgggagtttgggttttttgttttgttgttttttcaggcagccctctgaaccaaaatgggttcagagagactccctggaggttgggtttgatctcagactttgtctccagagcacatgcttttacccaccattgtgttatcctaccttccaagcttgcgtgaggctgaagtgtcttatgtacttgtagtttattcaaaggataaagtggtaaaatgccctcatagtgaaaaagtgaaaggtctgtgcatggcagtaaaaaagtgccaatgtgaccttggtctggccggtagctggtcaactcaggaaagagtcagctcccagagacccctactcagttgtaaggcttgtcttgggattgccccagctttactcagagaggaatgttgtagtgaaggtgactccatccaacaatttagtcaaacctgcttgcttgaatcaggccctctcaagtacctcctcccttcattactctattctcctttgagatactgggaaggaaatttagcaaatagctggtctaagccatcagctctcagatccactctatagattaagatatctggatcacatggaaatatttgtctaagttgataccagggacagacccaaccatggtctgcccccaggaggtgctcagtcaggatttactaataaacaaacaaaccatcatctagtattaaggactgatgattgtcactaggatccagcgataacttgacttaaagttctatttgccagaatattcagggttattgacattcaagggaactgactgacgctagccaaagtcacacgagactgataggtaagctagaatacctgggacattgatttttccagtgagtagtgaattcttgttcctcagcctaaggcacttcctggtactaaggtgcagatgcagactaaacaagatgattacccaacatgagccagagggtcagaacctggtgagggaagtttctccagggccctgcagaagccactgagctatccgtgccttgggtggatttaggaattttgaaagtgtgacttaggccgggtgtggtggctgacgcctgtaatcccagcactttgggaggccgaggcgggtagatcacgaggtcaggaaatcgagaccatcctggctaacacgctgaaaccccgtctctactaaaaaatacaaaaaattagccaggcgtggtggtgggcgcctgtagtcccagctactcgggaggctgaggcaggagaatggcatgaacgcgggaggcggagcttgcagtgagccaagatcgcaccactacactccagcctgggcgacagagtgagactccgtctcaaaaaaaaaaacaaaacaaaaacaaaaacaaaacaaaacaaaaaaactggaaaatctagtcctgcccaagctcctctctctgtctttgaggggagccaatctccagaaatcgctgctgtcttccccattaccctgcatggctgctggctcccaggtgaccatcccagaatctccaagtgttcagggccacctctgctgcatctgccagaactcccaagcttcactgacctcctatgatgatggggcccctggtgctgacacagctcagcctctttatgagaggctcctgcacagagggaccaggactgcactgacacctccttgcctagggctctgcttccacagctgggctgtagcccttctttcttccggtcttctcctttgttctgaagcaggaggacttcccagggcattccagtttgccgtgtttctttcactcattccgccaaacatatttattggtggccaattttgtgacatcaatgtgctaagcactggggtagtggtgaacaaaagttaggtccctgtccatgtagtttagggtccagctgagaataccaacatttaatgagacatcacaatgaaatgtgctgagagtcatggaacagagacacctaatctagtgggagagaaagcaaagccctttctaacaatgtgaagtttatgatgagaactggagaatgagtagaaattagccccgtaaaagaatgggggcgaagaggcttactgttttatacaaattgcttccaatagcagaaaaatgcttcatgagataattacctagatacagagttataaccaacattaaaaacaaaacaagcggccaggcgtggtggctcacgtctgtaatcccagcactttaggaggccgatgtgggcagatcacgaggtcaggaattcgagaccagcctggggaagccaacatggagaaaccttgtctctactaaaaatacaaaaattaaccgggcgtggtggtgggcgtctgtaatcccagctactcaagaggctgaggcaggagaatcgcttggacctgggaggcagaggttgcagtgagccgagattgtgccactgcactccagcctgggcaacagagcaagactccgtctcaaaaacataaaaaaaaacaaagaaaagaaaactaaaaacaaacaagcaaagaaaaaaaaatgcctttcaaaaagagagtatactttcaaactattttataagacttaatataacctagtctggtagcagtggctcatgcctgtaaccccagcattttgggaagccaaggcgggtggatctcttgaggccaggagttcgagaccagcctggccaacatggcaaaaccccatctctactaaaaatttaaaaacatttttttaaaaaattaggcgaccatggtggcacatgcctgtaatcccagctattcgggatgctgagacacaagaatagcttgaaccttggaggtggaggttgcaatgagctgagattgtgccactgcactccagcttgggtgacagagcgagactcttatctcaaaaaaaaaaattaatataacctctataacaatattagacaaagacagtgaaagaaaggaaagctataggctaatctcactgacaaacatacctggaaaaatcctaaataaaagttttgcaaatgaaaccaagctgtgtgtgtgagcatgtgtgtgtatttgtgtacaatgctaacttgacaatgaaaaataaaaaatccataaataatgacttatttcacttagcataatgtttttgaggttcctcaccgttgtagcatataatgtatcactaccacattcctttttttttttctttccttgagacagggtcttaccattgcccaggctggagtgtagtggtgtgatcatgtttcactgtagtctccgcctcctgggctcaagtgatactccaacctcttgccttccgagtagctgggaccacaggcacgagtcaccatgtccggctaatttttttttttttttgaggaagcaatttctttaattttatcagaatccaggacacaagaagaaaaacacccaaaaaccacatggagacagaagacaagacacaactcctcccccactgcctccctgctctagagtggggacaaagtgggggtgagacagctggggggagacctgaacctcagtccagccctacaggctccaggcctgcagggaaggagggtaacggggaggcagggcccagccccccagtgtggggaaacagctgagggaaggcccccctcaaaaggctccacctcctcaccagcactcctgcccagggacagggagcccacagcagcaaggggacccccggggccatggccacgttcatgactgagaagcagctgagtggaggcaggagacacaagattatctgggcagaatcagttggggcaggggcctgggagggccccatgggccaaaccctaaggttacaggagggggcccaaagtggggctagtgagtgaggtcctgagtgagtgggtcagtggctgggcctctttctccagctgcctgtagcccctccaatactgctgccaggggggcccgcctccagggaaatgggataagaaagcagcctgcccctactgcagacagagccaggtggctgaggccaggaaggaaggcccagccaggccttgccacctgcccctagaggcctgtgggaaaaggacaggtcaggaagggtggggacaggggctcgaccagctcagacccaagatggtgccatgcttacttgctgagtcccccatgagctggggtactgcactggggccagcgactagttagacaggaggcagcagcttctcaagaaattccttcacagctgccatctcctgaggacaggagctgtgcatgacacccaggtatgtctggaactggaccctggcaggtgtgacaacagaccggagcttctcagccatcagggccccaaaccgtacgggcaccatggggtccagctccccatggcactggaggatggccaggtccttggcactgccattagctgcctgggggaaggcccggtgcagaggcggccagcagctcaaagccaggatgccagccagagggtgggggcaggtgagggccatgtagagggacagggcccggccctgtgaaaagcctcccaggatgatttgattggcagggatcccgttcttcatttcatgctcaatcaaggccttgatgttctctgctgccttcttgatgccagcctcgtcctctggggcatctggactcagccccatcaggtcaaaccaggagggcatcaccatcttcatgttgagggtcacagggatcctaggctcatgggaacagatgtacttgacgtgagggagccgaatggtggagagggcgtcagcccagctgtgccctgtgtctccaagtccatgtaaaaaaataaccacggccgtttcccgctcagctccagacacggtggcagcatcgttgagcaggggcacagacatggtgttaccacacatacaccacacggctccatggcaggggcctccactccctgggacttctgaggccgcttgggtgattctcctctttctcccgcagacacacactcttccccctcggccgcccccgccggaacactaatttttttatttttttatttttagtggacatggggtctccctatgttacttacctagcctggtctcaaactcctaggctccagggatcctcttgcctcagcctcccaaagtgctgggattaccacgctcagcccatcactccctgtgttcctttcatttatttttttctttgagacagagtcttactctgtcacccaggctggagtgcagtggtatggtcatggctcactgcaacctcaacctcccaggctcaagtgatcctcccatctcaacctccctagtagctggcattcctttttatggctgaataatactccattgcctgtacagatcacaatttatttatccattcatcagttagtgggcatttgggctgttttcaccttttggctattataaataatgttgctataaacatttgtatacaagtttctgtgtggatatatatcttcatttttcgtgggtatatacctgggagtagaattgctggatcatctcatagataaacaaagccagacactagctaaagtggtaaggacaggacaggcacagaggctcacgcctgtaatcccagcgctttgggaggccgaggcaggcggatcacttgaggcaaggaattcgagaccagcctgaccaacatggtgaaaccccatctctactaaaaaacaaaaattagctgggcatggtggtgcacacctgtaatcccagctactcaggaggctgaggcaggagaatcgcctgaactcgggaggcagattttgcagtaaaccaagattgtgccattgcactccagcctaggccacatagcaagtctccgtctcaaaataataaataaataaataaataaataaataaataaagtggtaagaacagattttaatcagtgacatattattgcaatagggaaaagagcctagcttgaactgaactcaactttgatttgtagagataactgggcattttaaagcaagaatgaaagaacagagagggtgagtggggactcaatgacgtcagagaagtgacagattacaaaaagtgggaagggggttggtctgtgttaagcccacctggccttgttagctggggcttatcattaggctcctacactctcacagcagctgggaaacaggggccttaccttcatctgtgggctggaacaaacagtacattcttttggcagccttgagttctctcagtcagacactttaaagggcattagggtcatcctagagatgtggccttgaactgttagaaactatgttagtgttcatgaaagtctttatcaagtcggacgcagtagctcatgcctataatcccagcactttgggaggccgaggtgggcgggtcacttgaggtcaggagttcgaaaccagcctggccaacatggtgaaaccccatctctactaaaaatacaaaaaaaactagctgggcttgggggcaggcgcctgtaatcccagctactcaggaggctgaggcaggagaattgcttgaacccgagaggtggaggttgcagtgagctaagaacgggccattgcactccagcctgggggcaacaagagtgaaactctgtctcaaaaaaaaaaaaaaatcctggtttttttttttttacctttttttttttttttgagacggagtcttgctctgctgcctaggctggagtgcagtggtgcgatctcggctcactgcaacctccgcctccctggttcacgccattctccttcctcagcctcccaggtagctgggactacaggcgcctgccaacacaccccgctaattttttgtatttttagtagaggtggggtttcactgtgttagccaggatggtctcgatctcctgacctcgtgatctgcccgcctcagcctcccaaagtgctgggattacaggtgtgagccaccgtgcccagcccctggttatctttttgtaccttttgaaatatatgtaaatatgctggttttgcaaacattaaattaataataaaagccatgccatagcagactacatcatatataggtatataaccaataaagaattactgtctagaatttacaaagaactccacaaatcgatatgaaaaagacaaccaacccaagagaaaaaaaaatttaaatataggaaagacaatccctcaaagagaaaatagaaaatgcaaattaatactgacattttgggcttcaaaaaaaagcaaattaaaataacgacaagggctgggttcagtggctcacgcctgtaatcccagcgctttgggaggctgaggagggtggatcatgaggtcaggagttcaagaccagcctggccaagatggtgaaaccccatctctactaaaaatacaaaaattagccaggtgtggtggcaggtgcctataattcccgttactcaggaggcagaggcaggagagttgcttgaacccagggagggggtgggggcgcagaggttgtagtgagctgagatcataccactgcactccagcctgggcaacagtgagactccgtcttaaaataaataaataaataaataaatacatacatacatacataaaataaaataacgatgaggtgaaaaaaataaaattaataaaattaaaaataaaataataaaataacaaggcgacattcattaaattggcaaagacaggtttgggaatatcagatgttgctgaagctccagggcaacagggactttcttctagtggatgggagcgtaaaccagaaaaaccactgtggagaccatttggcaatatctagtagagttgataatacaactctacttatgagcttatacccagcctctcccacatttgctcaagaaggcatgcagaagtatgttcattgcagcattttttaatataacagtatataaagtaattggaaatactttaaaatccataaacagaagaatggatacattatttgtgatatatttatataattgaatattaaagagctgcgttatcccacatggtagcaatgagccacatgaggctatttaaacttaaatttaaataattaaaattacgtctatgtttcacattttaaaaatttaaatttagttccttggccaggcacggtggctcacgcctgtaatcccaccactttgccgaggcgggcggatcaggaggtcaagagatcgagaccatcctggccaacagggtgaaaccccatctctactaaaaatacacaaattagctgggtgtggtggcacatgcctatagtcccagctactcaggaggctgaggcaagagaatcgctcgaaccctggaggtggaggttgcagtgagctgagatcacgccactgcactccagcctggcgacagagcaagactccgtctcaaaaattagttcctttgtcacattagccacatttcaagtgctcagtagccacatgtgattagtgagtacccatattagacaatgctgatatagaaaatttccatcattgcagaaagttctattggacagcactgttctacaacataaaatgagctaactgggtctaaatatttcaaaaagaaaaaaaaacaaaaaacatcaaaatataagactcaaaaatatgaagttcatcagaaaaagaaggcaagttgtagaacacatagaatatcctcctatttaaaatttggtacagcatgatgactatagttaataacaatgtattgtaggcgcggtggctcacacctgtaatcccagcactttgcaaggctgaggagggcagatcacctgaggtcaggagttcgagaccagcctggccaatatggtgaaaccccattgctactaaaaatacaaaaattagctgggtgtggtggtgcgcacctgtagtcccagctacttgggaggctggggcaggagaatctcatgaacccggaaggcagaggttgcagtgagacgagatcacaccattgtacctcagcctgggcgtcatagcaagactccctctcaaaacaaacaaagcaaaacaggccaggcatggtggctcacgcctgtaatcccagcactttgggaggccgaggggggcggataacgaggtcaggagattgagaccatcctggctaacacggtgaaaccccgtctctactaaaaatacaaaaaaaaaattagctgtgtgatggctgacgccggtagtcccagctacttgggaggctgaggcagaagaatggcatgaacccaggaggcggagcttgcagtgagccgagatcgcgccactgcacttcagcctgggtgacagagcgaaactccgtctcaagaaaaagacaaaccaaaccaaaccaaaccaatatattgtattcttgaaaaatgttaagagattgaatgttgtgttctcaccacaaaaatggtaattatgtgaggtaatgcatatatgttaattagctagatttagtcattccaagtttatatatgcttcaaaatagcatgtaatacctatggaaactaagaattaggctgggcacagaggctcacacctgaaatcccagtgctttggtaggccaaggcaagaggattgcgtgaacccaagaatttgaaaccagcttgggcaacataggcaggccatgtctctacaaaaaatacaaaaaattagctgggagtggtggctggagcctgtagtcccagctataggctgaggtgggaggatcactggagcccaggtgtttgagactgcagtgagccttgactgtggcagtgcaccccagcctgggagacttgtctcaagaaaatactgaaaataaaaataaaaaagcaggccaggcgcggtggcttacgcctgtaatcccagcacttcgggaggctgatgtggatggatcacttgaggccaggagctcaggaacagtctggacaacaaggagaaaccccatctctatcaaaaaatacaaaaattaactggacatggtggtgcatgcttgtagtcccagctactctggaggctgaggcatgagaatctcttgaatccaggaggttgaatttgcagtgagccaagaagatcactctactgcactccagtctgggtgacagagctagaatttgtctcaaaaataaataaataaatatttaataaataaataatcaaaccaaaaccaaaccatcatgtcctatatgataaatatgtaaaatttatctgtcagtttaaaaataataggctgggcacattggctcatgcctgtaatcccagcactttggaaggccaaggcaagtggatcacctgaggtcaggagtttgagaccagcctggccaacatagtgaaaccctgtctctactaaaaatacaaaaattacctgggcgtgtaatcccagcactttgggaggccgaggcaggtggatcatgaggtcaggagattgagaccaaaaaaaaaaaatttttttgagacagagtactctgtcacccaggctggactgcagtggtgtgatcttggctcactgcaacctctgcctccccagttcaagggattctcctgcctcagcctcccgagtagctgggattacaggtgcccacaaccatgcctggctaatttttgtatttttagtagagatggggtttcgccatgttggccaggctggtctcgaactccttacctcaggtgatctgcccatctcggcctcccaaagtactgagattacaggcgtgagccaccacacctggcctctaagaactcttttttttttttccgagacggagtcttgctctgtcacccaggctggagtgcagtggcccggccataaaaactcttgaacaagaatggatgggggctgggcacggtggctcatgcctgtaatcctagccctttgctgaggttggcaaatcacttgaggtcaggagttggagaccagcctggccaacatagcaaaacactgtctctactaaaaatacaaaaagtagccaggcgtggtggaaggtgcctgtaatctctgctactcagaaggctgaggctggataatcccttgaacccaagaggtggaggttgcagtgagccgagatcttgccattgcactctggcctaggcaacagagtgcaactgcctctcaaaagaaaaaaaaaaagaattgatgggttggcagggtactgacacttggaggtgctgggagggtggtgcccagatgggccatggaagcgccaagcctcttcctcccaaaagctcaccctatgcatcttttaaatccagctattcatctatatctttaaaacgtcctgcataattaagtgataaacgtgtttccctgagttctgttagcaatcctagcaaattatgaagccaaggagggggttgtaggaaccctgatttatagcaggtttgtcagaagcacagatcacagccttggtcttggaattggcatctaaagtgggaggcagtcttttgggactcagccctccccctgtggaatctgataccatctccaggtagctagtggctgaattgaatcaaataggccactcagtatttgctggatagttaactgtttggtgtgtggagaaaaagtcccatacatctggtcacaagtgttttgtgttgtgtgagcagacagggagggtcttcagggattacagaaatttaatcaccctgagcaattggcttgttttacagcctcctgccgtgcagcctcttttttcctaaaccctgtgttgactgcagtcacctagttggttaaaactggctcctggcagaccccagaaacttgtagataaacctgagtgaaagttcctcattaccatgctgaaatctccatcctgggaggagctgtggcttcattctcatagcatgtgacctgtgtgcgggcgtgaggattcactgtgtttccaaaactgggacccctcctctacatgcaatgaggcaccctctcccctccccatcaccccctaaaatcctcctgtcacttctctccgggagacactgctttgaagaatcctcccagtgctctccttacttgtaattaaactcctgttgattaaaacctgccttgtggagagtcatttgttatttgccaggcaaacaaaccctgttttttttcaggtaacaagagtatggtggaagaaaacagtttaggtcaggcacagtggtgcatgcctataatcccagcactttgggaggccgaggcaggtgggaggaacacttgagcccaggtgttggagaccagcctgggcaacatagtgagacaccccccaactccacccccataaaaaaaaaaagaaaaaaagatgtaatcccagcactttgggaggctgaggcaggcggatcacttgaggtcaagagttggagaccagcctgggcaacatggtgaaaccccgtttctattcaaaatataaaaaaattagccaagcatggtggtgggcgcctgtaatcccagctactccagaggctgaggcaggagaattgcttgaacccgggaggtggaggttgcagtgagccgagatcctgccattgcactccagcctgggtgacagatcgacacttagtctccaaaaaaaaaaaaaaagaggccaggcacagtggctcacacctgtaatcctagcactttgggaggccgaagcgggtggctcacctgaggtcaggagtttgagaccagcctggccaacatggtgaaaccccatctctactaaaaatacaaaaattagccgggtggggtggcacgggcctgtaatcccagctacttgggagactgaggcaagaattgtttgacccgggaggtagaggttgctgtgagttgagatcgtgccaatgcactccagcctgggtgacagggtgggactctgtctcaaaaaaaaaaaaaaaaaaaaaagtttgtgtttacagttgtataaggaagtggtgtctgtgaggtttgctgaggctcagaaattaataccccaaaatatgccaacatgctgaactgaagaagaaacttcaaggtttctctgacctctcttctcaaccagctctcccacaggcaggatgagttattctctgaagttcctttatctgcttcaagtccagacataccacaaagaataattgttttctcttcccctccctgtaagatcaggaatggaatcacacctgagcaggtcctttcccaaaagagtctgtctctcagctcattcacattccacagggaactattcaaaactcaatctctatctctgggcccattcattctccctaataatcgcctatggcccctcaagagaattcctgttccctatcccataacctgttttgccaggatggtaaataagctcctgaaccctgttgtggattggttaatcactctgtggttctctctgtgtacacattaatccatttatatgcctcttctccaatgcaccttttttttttttgttttgttttgttttgttttttggacagactcttgctctgtcgacagggctggaatgcaatggcacaatctcagctcactgcaacctccacctcctgggctcaagtgattctcctgtctcagcttcccgagtagctgggattacaagcacacgccactgtgcccagctaatttttatattttcaccatgtttccaggctggttttgaactcctgacctcaggtgatccacccgactcagccccccaaagtgctgggattacagatgtgaaccaccgtgcccagcctgcatctatctttcgtgagttaattttccagccaaccttcagagggcgaaagggaagttttcctttggcccatacaggttcattatagctattctatgtagttttctacttaagtatgtcataatttcaaaagagaaaaagagaagggagaaaattgttctaagctttcaatgtgaaggcctggcacttttaaagaataacagcttctgtggccagacttttagtatcagtatggactttccctggagaagtccagccagatgggcagactgggcagatgcttatactgattagctagatttagctaatgggcagagccgtcacaatgcactggttgaaatggtgcaaaaaaataatgtaaggcttttttttttttggtacaggatctggctctgttgcctatgctggagtacagttgctcaatcttggctcactgtaacctccgtttcctggactcatgccatcctctcgcttcagccttctgagaagctgggactacaggaatgcaccatcacacccggctaatttttgtattttttgtagagatggggtttcaccgtgttaactaggctggtctcataaccgcccaatgtgtttaccttgcccgctgcctagacagagccgatttctcaagacagaggaattgcaatatagaaagagtaattcacgcagagcctgctgtgtgggagacaggagttttattattactcaaatcagtctgcccaagaattcgaggagcagagtttgtttttgttgttgttgttttgttctgttttttgagatggagtctctctctgtcacccaggctggagtgcaatggcaaaatcttggctcactgcaacctccacctcccaggttcaagtgattctcctgcctcagcctcagtagctgggattacaggcctgtgccaccatacccagctgatttttgtatttttagagacaggatttcaccaagttggccaggctggtcttaaactcctgacctcaggtgatccacctgcctcagcctcccaaagtgctgggattagaggcacgagccacctcgcccagcctggggagcagagtttttaaggacaacttggtgggtcaggggaagccagtgagccaggagtgctgattggtcagagatgaaatcatagggagtctaagctgtcttcttgcgctgagtcagttcctgggtgggggccataagatcagatgagccagttaatcaatctgggtggtaccggctgatccatcaagtgcagggtcgacaaaatgtctcaagcactgatcttaggagatgtttagggagggtcagaatcttgtagccttcacctgcatgactcctaaaccgtaatttctttctttctgttttgttttcttttttttcttgagacagagtttcgctcttgttgtccaggctggagtgcaatggcgcaatctcggctcactgcaatttctgcctctggggttcaacccattctcctgtctcagcctcctgagtagctgggattacaggcacatgccaccacgcccagctactttttgtatttttagtagagataggggttcatgatattggtcaggctggtctcgaactcctgacctcaggtgatccgcccgcctctgcctcccaaagtgctgggattacaggcatgagccactgcacccagcctaaaccataatttctaatctgtgttagtcctacaaaggcaatctagtccccaggcaagaaggaggtctgttattgtctttgttttaaagggctattaaaacaaagggaaagggctattattgtctttgttttaaattataaaccaagtttctcccaaagttagttcagcttaggcccaggaatgaatgacagcttggaggttagaagcaaaatggagtcggttaagttagatttctttcactgtctcagtcataattttgcaaaggcagtttcagtctctaactcctgcgctcaagcaattcacccacctcggcctcccaaagtgttgggattacaggcatgagcaaccatgcccaacctgtaaggcctttttaaaaaaatataaaatcagatatgaagttttctttggactgggcgtggtggctcacgcctgtagtcccagcactttgggaggctgaagcacgtggatcacctgaggtcaggagttcgagaccagcctggccaacatggtgaaatctcatctttactaaaaataaaaataaaaactatccagccgtggtgatgggcgcctgtaatcccagctactcaggaggctgaggcaggagaatcatttgaacctgggaggtggaggctgcagtgagccgagatctcgccatcgcaaatcagcctgggcaacaagagggaaacacacaactctgtctcaaaaaaaaaaaaaggtttctttgaagaattgttgccagaaagtggtcatgatccaaaccccaagagagagttcttggatctcatgcaacaaagaattcaaggcaaatccataaagtgaaagcaagtttattagagaagttaagaaacgaaagaaggttactccaaaggcagtgcagccctgagggctgctgtttgcccattgttaagttatttcttgattatatgctaaacaagaggcaaattattcatgcctcccctttttagatcatatagggtaacttcctgatgtttccatggcatttgtaaactgtcaggttgctggtgggagtgtagcagtgaggacaaccagaggtcattctcatcgccatctttgtttcggtgggtttcagccggcttctttactgcaacctcttttatcagcaaggtctttgtgacctatgtcttgtgccgatctcctatctcatcctatgacctagaatgcctcaagtgtctgggaatgcagcccagtacgtttcagcctcattttatccaacccctattcaagatggagttgctctggttcaaatgtctctgacagaatggaagtcccctttctatttgtttgttttaaaaaataaagtcaggccgggcgcggtggctcatgcctgtaatcccagcactttggaaggccgaggcaggcggctcatgagccgggcgtggcgagcgcctgtagtcccagctactcgggaggctgaggccggagaatggtgtgaacccgggaggcggagcttgcagttagccaagatcgcaccactgcactccatccagcctgggcgacagagcgagactccgtctcaaaataaataaataaataaataaataaataaataaataaataaataaataattaaaaaaataaaaaataaagtcagagtttctgctatattgcccaggctggagttcagtgactattcactgacgagatcactgtgcactataacctggaaatcctacagtcttgaactcctggactcaagggatcctcctgcttcagcctccagcgtagctgggactacaggcacgcaccaccacatcaggctcagaagatcacttttaattagcaaacggctcactagcaagatttgaaaaacttcaaaaagctaagtataactctcaaatcgaatgcatttttactttgcacatactgttctcaagattctggcatccaagaaaaaaaaaataatacttctcctagggctaataaatttgtaaagacttgctattacatgacttgtttcaaatgtttgcagcatattgtttatataaattataatggtttccgtgaaatttaataatggttcaaaatttgtatcatttgagataagtgaggcatcagtgaatttactatgcttttcccacgttgtgttatattcaaagacaaaaatctatggctaggtatggtggcatacgcctgtagtcccaactactcctcagactgaggcgagagaatcgcttgaacctgggaggcagaggttgcagtgagctgagatcgtgccactgcactccagcctgggtgacagagcaagactttatctcaaaaatttaaaaataggccgggagcagtggctcacacgtgtaatcccagcactttgggaggccgaggcaggcggatcacgaggtcaagagattgagatcatcctgcccaacctggtgaaaccccgtctttactaaaaatacaaaaattagcagggcattgtggttcgcacccgtggtcccagctactcagaaggctgaggcaggagaatcgccaagatcacgccactgcactctggcctaggcgacagagcaagactccatctcaaaaaaaaaaaaaaaaaaaaatagaaacacagtggctcacaccagtcagtaatcccagcactttgggaggccaaggcaggtggatcacgagatcaagagttcgagaccagcctgaccaacttggcaaaaccccatcacaaaaaacaaacaaacaaaaaaactctcggcaaaacagagcaaggctccatctcaaaaaaaaaaaaaaaaaaaaaaattagccaggcgcgatggcggttgcctgtaataccagctactcaagaggctgaggcaggagaatcacttgaacccgggagctggaggttgcactgagctgacatcgcaccattgcactccagcctgggtgacagagcgcgactctgtctcaaaaaaaaaaaaaagaaagtgatcacattttgggaatgcattgactataccctaaaaagctcaggagaatatacagttgaggctgggtgtgatggctaacgcctgtaatcccagcactttgggagggcgaggcaggtggatcacctgaggacaggagtttaagaccagcctggccaacatggtgaaaccccatctctacaaaaatacaaaaattagccgggcatgatagtgggtgcctgtaatcccagctatttgggaggctgaggcaggaaaatcgcttgaacccgggaggcggaggctgcaatgagccgagatggcgccatggcactccaggctgggtgacagagcgagactccgtcttgaaaaaaatgacatcactatacttcacatgggctcatttattgtcattattattattattttttgagacagagtctcactctgtcgcccaggctggagtgcagaggtgtgatctcggctcactgcaacctccacctcccgggttcaagtgattctcctgcctcagcctcctgagtagctgagactacaggtgcccgccaccacgcccagctaattttttgtatttttagtagagaccgggtttcaccatattggccaggatggtcttgatctcttgacctcgtcatccgcccgcttcggcctcccaaagtgctgggattacaggtgtggcgctcatgtattttgtaatatattttcttttcttctttctttttttttttttgtgtgtgtctgtgtgtgtgtgtgtagaggcatggtctaaatatgttgcctgggctagtctcaaactcctgggcttaagtaatccacccactttagcctcctaaagtgttgggattacaggcatgagccattgtgcccagcctgttatagactttaaaataaatttgtttatgtatttgcttataccctgcacaccctaagtgcagtgtagcctcaacatgtccaagcagagcccttgaccttctccacaaaactcctcctcttttggtgcctgtctccctgtgactgactttgccagccacccagttgctcaagccaaaaatctgacattctccctccaactaccttctctgctcgccccacccatttcatgtcttatccatctccaggtcctgctggttctgcctgttaagaaccttccacatctctgacctctctgcatcttcacaactacacttttgttcaggtcctcttgcctcttgcctggatgactacagtggtgtcctaactatctttcctcatcctcacccaattactgccaatctattctccattttgtagctagcgtgttctttcaaaaatgcaaataccttcacatcactgcctaaattaaagagcaccccctctcattgctgaagtgtaaagtcccatgatctgatatgttcccttatcaactaacaagggccctacagttaagaaaaccaaagttacttctggctgggagtggtggctcatgcctgtaatcccagcactttgggaggctgaggcgggtggatcatgaggtcaggagttcaagatcagcctgaccaacatggtgaaaccctgtctctactaaaagtacaaaaaattagctacgcatggtggcgggcgtctgtaatcccagctactcaggaggctgaggcagagaattgcttaaacctgggaggcggaggttgcagtgagccgagatcgcaccactgcactccagcctgggcgacagagggagactccatctcaaaaaaaaaaaaaaagaaaagaaaaaaagaaaactaaagttacctacaggtagagggttcagagtctggctggcatggcaaatttctaaattcctatggctataagaaaagccatagtcttactataaactctctaacaatagggagttaggagctatcagacccctcttaactatgatttacaacccagatcactacaactccgagtagacgaaggacaggccttccaaacattctgtttttattttattttattttattttatttttttgagacggagtctcactctgtcgccaggctggagtgcagtggtgcgatcttggctcactgcaacctctgcctcccgggttcaagtgattctcctgcctcagcctcctgaatagctgggactacaggtgtgccaccatgcccggccaattttttttgtattttcagtagagatggggtttcaccatgttggtcaggctgttcttgaactcctgacctcaggtgatccaccagccttgggctcccaaagtgctgggactacaggcgttagccaccatgcctggctgaatgtgatcgccttcaatgatggcagcacccctacattttacacaggaccaccagtagggtggataggtgagcggcctgtaggtggaatgagaagggcagtccctttcttttccttctttttttagtagagaagtggtctcactatgttgcccaggctgatgctgaattcctggtctcaagcaatcctcccaccttggccttccaaagtgctgggattataagggtaagccactgcaccaggccaagcagtcactttgacataaagaaagtccatcccttgaccagcacagctaacctgggagagcagaaggtcagcacatcaattgaagagaagagaggacattaatgggaagagcctgttgggttgtggaacaaccttcctgaaagctttgagaggagataggcagagctattcccagaggacaatctggcatgtagcacagaggctgtggagtggatgggatgactttcctgggtgccagtgaagcatgtggcgcgacaccatcagtgagggacacacaggacgaaggactcctttgactacctgccactctaaggtaacagagataccaccacagttggaacacaaagaatgggggcgggggagccatcactaggacccacacatacagctcaagcttaagggtcaaagtggaccagccggtagcccaatcatgtgcgatccataaaagaaatacctctctgctagcagaattgatcctacaaggctacagaaccccatgagcgcccaatgggagcgagttctctgctggcacaggctggcccttggctctgtagagtgacttaggaaatttcaaggaagatactccaaagtgcagagtcccttcaaacacagggtccgaggcagggcccaggccactcaggctactccacggtactctgtggaggcatagcaacaatgtctaggctgggtgcagtggctcatgcctgtaatcccagcactttgggaggccatggaaggcagatggcttgagtccaggagtttgagaaataacagtggcttaaacaagagacaagtgaatttttcctgtaagcaaattctgagataaccagtccaggactggtgcagaacttccaagattaccaggaaggcaagacatttctaatttgtggttcttttttctttttttttttttttttttgagatggagtctcactctgtcgcctaggctggagtgcagtggcacaatcttggctcactgcaaacttcccctcccgggttcaagcgattctcctgcctcagcctcccaactcccaagtagctgggattacaggcacatgccaccacgcccagctaatttttgtatttttagtagagacggggtttcaccgtgttggccaggctggtctcaaactcctgacctcaggcgatctgccctccttggcctcccaaagtgctgagattagaggtgtgagccaccacgcccggtgaagcttgtggttcttctattctcaacaaatggcatggtttgacggggaagggcatactccttcctttagggctctccctgaaatgtggatatattacttccatttgtgctctattggccagagcactgtccattgccatacctagtctcaagagaggctgggagttgagatcttttttggtggccatgtgtcttgcaaaaaaaaaaatctagggtttattaacacgaaaagattggagaaacaatactggggggaaactaacagcctctatcaaaggctcagtgtcagtatcagtattatgctcagctgtgagaggctggaccaaggttgagagcctgagccacagcaccctgtgtgggcaggacacccctgggcaggcctgtagcactcgaggtggccgggcagaaaaccttgccctgtggggatctctatagcagatggtggcaaactgcatgatgcagaagaaaaggagtgtttactctttttccccatgttgcccaggctggtcttgaattcctgggctcactccagcacagactttgcccctgtaaaccttcacccttccccatcctggaagtagggaatcccgaccaactgacagatttgtaggagactcctgctcctatccccagggtaaagccttcatggtctgccccctcctacccatcccgccagcctcagctccccagactgttccgtgctgcagcccttctcagttctgcacacttgatgagcccggctctggcctgtcgtgccctgctgctgctgctcagggatacgtacaattgtacagactgtgctaagaacttcacatgcatgatctcttttagtttttgtcgctgcctctctgctcatctgtactcctcactgggcaggaactttgagaaatggaggcccacatctgttgtgttcactgctgtaatcccagcaagcagcatggtgcggcaccttcacagggcctctggctccagatcgttggcacacagtaagtgtttctttttttaaaattattattattatttttatcgagaaggagtctcgctgtgttagcccaggctggagttcagtggtgcgatcttggctcactgcaacctccgcctcctgggttcaagcaattctcctgcctcagcctcctgaatagctgggattagaggcccgccaccacgcccaactaatttttatatttttagtagaaacgcggtttcaccatgttggtcaggctggtctcgaactcctgacctcatgatccgcctgcctcaccctcccaaagtgctgggattacaggcgtgagccactgcacccagccataagtgtttcttatgttgaatttgcagcttgtataaaaatgaaccaagacattatgaaatacagtcactttttttttttccttttgtgactaatttttcttaaggagcagtgatcagggaaaggaagatgtttccctagaactcctctagagggcatatcttccctggatctttgacattgattttcggagcggtaatggatcttacacaaggagtggccatcccctaggaggcctgtccacgcagatggagggtgtggtggtgctgagtgatgtctccctggcagcttggactggagaccctagagggaggtcttcatgtccaaaggcagggatctggaagaaggggaatgtgtgtgcacagactgccccctgcccttttttttttttctttgaagacaggatctcactctgtcacccaggctgaagtacagtggtgtgatcattactcactgcagcctcgacctcccaggctcaggtgatcctcccacttcagcctcccgagtagctgggactacacctatgtgccaccatgcctggctaattttttgtagagacagggtttccccatgtttcccaggctagtcttgaactcctgggctcaagcaatccacccactttggcctcccaaagtcctgggactacgggcatgagctactgtgcctggtctagactcccccttttttttttttttaatgagatggagtttcactcttgttgcccaggctggagtccaatggcgcaatcttggctcaccacaacctctgcctcccgggttctagaaattctcctgcctgaacctcctgagtagctgggattacaggcatgcaccaccacgtctgggtagttttgtatttttagtagagatagggtttctccatgctggtcaggctggtctcaactccccacctcaggtgatctgccagcctcagtctcccaaagtgctgggattacagattacaggcatgagccaccgtgcccggcttttttttttaggcggagttttgctcttgtcgcccaggctggagtggaatggtgcgatcttggctcactgcaacctccgcctcctgggttcaagcaattctcctgcctcagcctcccaagtagctgggattacaggcacccaccaccacgcccagccaatttttgtatttttagtagagatggtgtttcaccatattggccaggctggtcttgaactcctgacttcaggtgatccacctgactcagcctctcaaagtgctgggattacaggcgtgagccaccacaccgggcctagactcccatttttatttaacgtcttccatttcttatcagagaaatgataataaaatatagaaaagcacaattctttattttaaccccacctctcgctcacttaaatgaccagttatttccaagtctggatctgaaaatttctattatgagagactctccaggaccttcattcagttccacgtgtagttgtgacattgtgtgatattggcacacggttggaaataacacttgtgtagcagtttgagatgaaatataggcaatgcctggcttctgaaagtgccttcaggcctgatgttacacaagcattctcagcccaacttgcctcccctcctatttctatctctacctttagctgggtatttggatagttcaggggaaaaaggggtaaagatgagatgacaaaagacaccccagccgctgggcccagcactttgggaggctgaggtgggtggattactgaggtcaggagttcgagaccagcctggccaacatggcaaaaccctgtctctacaaaaaatacaaaatttagctgggcatggggtgcaggcttgcagtcccagctatttgcggggggaggggagctgaagcaggagaatagcttgaacttgcaaggtggagtctgcagtgagccgagattgtgccactgcactccagcctgggtgacaaagtaagaccctggctaaaaacaaacacacacaaaaatatatcattatgcatttctgaaagcaaatgtgctataatactgctttgatctgaatgtcccccaaaattcatatgttgacatttaatctcaactttggtggtattaagaggtgaggttgtttgggaagtaattaagtcatgaggactccactcccatgaatgaattgagggaaagggctggagggaagggctggagggaactagcttcggcccttttttgtccttctaccatgtgaggacacagcattcatctcctccggaggatgcaacaacaaggctctatgtgaagaaggaaccaggtccctcaccagacactgtacctgccggcaccttgatctttcacttcccagccctccagatctgtgagaaacacatttctgttgtttataaattactctgtctcaggtattttgttatagtagcacaaacagacttagacaaataacgttttatgtttacaacccataggaggaaaattctggatttggaatctatcttggcaagataatacatagatatgattataagaaaatcagtgaggtcataaacagtggcttaccaacataggttggtatacaaatataacttcacataacaaatatagttgacttgaagtaaacaaacacaatctactatagcattctgacaaatgtagtttcctataacaaataatcaaagccttaagtttcaggttacagttttcagagttagtagtagccaattactgccaggcatagtggctcaaacctgtaatcccagcactttgggaggccaaggtgggaggactgcatgagcccaggagtttgagaccagcctgagcaacatggtgagaccctgtctctattttatttcattaaaaattttaaaatattggccaggagcagtggctcatgcctgtaatctcagcactttgggaagctgaggcaggcggatcacttgagatcaggagttccagaccagcctagccaacatggtgaaaccccctctctactaaaaatacaaaaattagcctggcatggtggtgcacacctgtaatcccagccacttgggagactgagtcagagtcgtttgaacctgggaggcagaggatgcagtgagtccagatcgcaccactgcactccagcctgagtgatagagtaagactctgtcttaaaataaataaaaaaaaattatttaaaaaaagaagtagcctatctcagaggctacgcgactttattacagttttaaaaatggaatggtaggccaggtgcggtggctcacacctataatcccagcactttgggaggctaaggcgggcagatcacgaggtcaggagttcgagaccagcctggccaatatggtgaaaccccgtttctactaaaaatgccaaaattagctgggcatggtggcggatgtctgtaatcccagctactcaggaggctgaggcaggagaatcgcttgaacccgtgaggcagaggttgcagtgagccgagaacacgccactgcactccagcctgggggacagtgcaagactccgtctccttggccaggcacagtggctcatgcctgtcatcccagcactttgggaggctgaggcgggtggatcaggaggtcaggagatcgagaccatcctggctaacatggtgaagccccatctctattaaaaatataaaaaattagctgggcgtagtggcgggcgcctgtagtcccagctacttgggaggctgaggcaggagaatggcatgaaccccggaggcagagcttgcagcaagccgagattgcgccagagccagactctgtctcaaaaaaaaaaaaaaaaaaaaaaagactccatctccaaaaaataaaaaattttaaaaatggaatggtagttacctttgctagagactgagcatgcataaaagtaatcttaaataactttttcgcctttggccaaatgttggttcattgtgatttggagtctaccattactataactgtatctgtacctataccaatatctgtacctgtacctatacctacatatgtacttatacctataccatctgtcctcccctgaaagacctcatcaaagttctcatcttgcaatgtttcctgttaaatatcatcatgactacttttaacctatttgaatcaaggctgagttacagccttttaaatttttgaataatttttttttttttttgagatggagtattgccctcgttgcccaggctggagtgtggtggcacaatctcggctcaccaaaacatccacctcacgggttcaagcaattctcctgcctcagcctcctgagtagctggaattacaggcacatgccacaatgcccggctaattttttttgtatttttagtagagatgggatctcaccatgttggccaggctggtctggaactcctgacctcaagtggtccttctgccttggccttccaaagtgctgggattataggcatgatccaccatgcctggcaatttttttttaagagcacaaatccacgtttatttattgacttttcttttttctttcttctctttttttctctttttctttttttcttttttttgagacggagtctcgctctgttgcccaggctagagtgcagtggcacgatctcgactcactgcaacctccaccttccaggttcaagcagttctctgcctcagcctcccaagtagctgggattacaggtgcccgccaccacacccggcttttttgtatttttagtagagacggggtttcaccatcttggccaggctggtcttgaactcctgacctcgtgattcacccgcctcagcctcccaaagtgctgggatgacaggcgtgagccaccgcacccggcctattgacttttcattagtttaaatccttgaagggtacagcatcactcggattctgtgtccaatagccttagtgggaagattgcttcagaatttggcacgaatcatgtcactgtttccgtgggcctgcctcagcctcccgagtagctgggattacaggcggccgccaccacgcctggctaacttttttggttttttttttttttttttttttttgagatggagtctcgctctgtcttccaggctgtagtgcagtggcgcgatctccgctcactgcaagctccgcctgccgggttcacgccattctcctgcctcagcctcctgagtagctgggactacaggcgcccgccaccacgcccggctaattttttttgtatttttagtacagagagtttttcaccatgttagccaggatggtctcgatctcctgacctcgtgatccgcccgcctcggcctcccaaagtgctaggattacaggtatgagccaacgcgcccggccaccaaatagtgtaatttttacagttacactttgtaactagtgttgctgaagacggaaatgcaattgattttgaaaattgattttttcctcttactgattttttatccatcaaccttgctaaacttatttatcaattctatctgaattttattttagggatgctgcacatgcaataatttcatctgcgaatattaacattaatgtttcttgtagtccttatatatttgttgcttattggactggctacaacttccattgttttattgatgaggattattgagagcaggcatccttgccttgttccccatcttgaaaggaacgctttcaacatttccccattatggtgatgtgttttgcgaaatttttgaagatgtcctttatcagcttctggagttttaaaaaaaatatcaacgggtgttgaatattttgagtgactttgctgcatcaattgagatgaatacattttccccctttaatctgctaatgggtctatatttctccattccatttaaatttttttttaatttgataaatatcttttgctatatgtttcttctcaggtctcccttctcagttatccccctttaccttccattgttggttttctctagtttcttccttttctttttactgtgttctcttcaagctcttgctttttggagttttcccaggatatcaaaggttggggggatggcaacatggttttcagacagtgtgtctccccacaatctgcttctctctacaagcttgtttgaagccaagttaaagcaatggatagaagacggcagcgcgggtgtcagacctgccaatttccaactgcacaccaaatccccgaacatatgcttgaggcccctgcctttcggtttcataaataaaaccctgtcctgactacctccaggattggatggaaactcggatgagtaaatatggtagaacgactttgcaaactagcaccctattcacacgtaaggggttgctcttgtcaccgagactgttagaggcaacgtgagttaacagaaatagcttggattttgaagctaatggaatctagatccattcctaaccagcagtgtgaccttattgtgtaatctttctgaacctgtctccatccatctctacaaagaatgtggcacaatgtaggaactcagtgaattttcgtgattaaaagacgagataatacaggtgcacaatctgcaaaacataaaatactccataaatggaagcagtaaatcttccccgagctcgagactccaaaggccctgagcccagtaccagtaacagcacccaggtaagtaggctggctgagagaagagggctataaagaaaagttctttcctgagctttgaatccccactgtcaggcttcaatggagcgcaaaaattcctaaatttggtgagaaatggcaacattaccagggaatgaacagaccaggccactcacatccacgtgagggctccaggagccacttccgggcccagtcaaccacgaccaggagaggcagcgctggagcctcaatcacgtcgacggaaaacaagtgcgctccctactgcagtcaccaggaggcgctagtcccgcctgtctcccggcacgggtcctcgtttgcgcacgcgtcatttctttcctccagcgtccccgccccttctcctccggccgccaccagtttcgcttggccagttgcgttcgtgcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcaggtgagtaggggcggcgcaggtgtcctgccctggggatggggacgaaggctgaccgctccgatgctgtcgcgcccccggctcccggtcggcctttgtcatgtctaccgggagagcgaaggtccgtgcgcccccgcacaagtggaaaggggcggaggcaggagtggagacggcttagagcacccggggaggtcggaaggcacgtctgtctgccctcccctagcttcaagtttctggagcccctcccttaactttcatgtctccgagatttctcatttcgaattctcaggctcgtctgacacatttccacttctttattcctactcagggtgtgattgcagtgtgtaagaagggagagttctgatatgacttcttccttttggggacatggtgtctgaggccacatccttgctgaggtccttttgtgttaatcgcctctccttatcactgctgcttcggagtgtaggaaagggagaaggagagtagggtaatctgggccaaaagacttctcattctctctctcctttcccaaattgtgcagattcctgcccaatgaaactgattgatttagttctttctcttaaatggtgccctgctgcaccccacaaccatatgcagcttcctgtctccagtgaagagagatgaatgtgtgtgacagctggagtgtacttatctctggtgccaggaaaggtctgcctgaatcctttgtttactagtatttcacgttcaggtttccctgaagttaggattcagccttaagagagattctttctctcgtgacaaccagagagcagagtagtattatgtgacagtaagaagtagtaaaagccttctcagatctattaatcaagtatttattgagcacctactacatgctaggcgtggttgtaggtacttaggatgcagcagtgaacaagggacaaatcgttgccatcgtggagctgccattctatggggatacagacaataaatgtaataaatgaattatataactgccagaaggccgtaagtgctgtggagaaaaggagaaattcaaggttgaggacataggggaggccaactggcgggttagagtattaaatagggtggtctcagtaacccccatggaaaagatgagttgaataaagacttgaaggaagtgagggagacagacaagcagatagtgagggaagaacatttcaggcagagggaatctgctagagcagagtccctaaagagttgtaaggagggaagtgtggctggaatgaagtgagcaaggggaaaagttgtgggaaaggaagtcaggtaatgggtagtggggttgctgatcacagtttgtccttgtgggggtcgttgtgaggacttttactctgagtgagatggggaatcattggatgattttaagcagagagataagatttgttgggtccaccagattttcgtaaccatagcaccattgcctttttttttttttttttttttttgagacaggttctctttctctgttcccaggctggagtgcagtggcatgatcatggctcactggagccttaacttcctgggctcaagtgatcctcccacctcagcctcctgagtagctgggactacaggcagctgccaccatgcctggctgattttttgtatttttaatagagacagggttttgccatgttgcccaggctggtctggaactaactcctgggctcaagcaattcgcctgcctcggcctccgagagtgctgggattacaggcatgagccaccgtgccctgcaacatttttttttttttttttgagaagtagtcacgctctgtcgccagcctggagtgcagtggcgcggtctcggctcactgcaacctccgcctcccgggttcaggcgattctcctgcctcagcctcccgagtagctgggactacaggcgcctgccaccacgcccggctaattttttgtatttttagtatagacagggtttcaccgcgttagcccggatggtctcaatttcctgacctcatgatcctcccacctcggcctcccaaagtgctcggattacaggcatgagccactgcacctggccaacattttttattgtcgtgactaggtggggggttgctactggcatctagtgggtagagggcagggatgctgctaggcatctgacagtgtacaggactgcattggacattgtcaaatgtcaccttggggataaaatcacccccagttgagaaccactggtttatgataatctaggtgccagatgatggtgtcttaggtcagggtgatagcagtggaagaaacagtaaaaagtgattggattctggatatattttgaaggtacaatcagccatgctttgctgacagattagatgtggtatgtaggagaaagagaggactctgggtttttggcttgagcaactgaaagatggagttatatcaattgagatggagaaagctgcaaaaggagcaagttcaaagcagggttggacatcaagaggtcagttattagacttccaaatggagattttttttgatacggagtctctcactctgttgcccaggctggagtgcagtggtgtgatctcagctcactgcaacttctacctcccagcttcaagcaatcctcccacctcaatctcccgagtagctgggattacaggcacgtgccagcacacctggctaatttttgtatttttagtagagacagggttttgccatgttggccaggctggtctcgaactcctgaactcaagtgatccgcccgcctcggcctcccaaagtgctgggattacaggcatgaggcaccactcccagccttaaatagcgatgttgacgatgcagttcagtataggtgcaggatcgaggtctgagctggacatataaatttggaaactgtcagcatatcaatgatatttaaaggcatgggagtggatagtgagtatagatagagaatgctgttaaaatctggagagatgaggaggacctgccagtgaggtaagaaagagtggtctcctggaagctaactgaagaaagcctattaaggaaaagggagtaatcagttgtatcagatgctgtttgatgggtcaagaaaatgaagataaagaattgacttagcaacatgaagttacttgtgatcttgaggatagcaatttcgatggaatggtgggaatgaaagcctgattgcaatgggcttaggagagaaattggccacgatgaatacactagaggtaatactttagagttttgctgcgaaaggcggcaaggaaaaaggatagtacctgttagggaaagcagagttcagattcttttagtttcgaagaaataatagagtttgtggtatgccaattggagtgatgccatagagtacaaagctgatggtgcagaggtgagaagggaggattgctggaggaatgttcctgaaactgggaggatttggcgagtccaggatttggtgaggagggatgggaatgtgatgcatatatgaaagggttgccttaggagcagggccatccacctctgatcttgtggtgaggtggatgtaggcagggttgcatgaatatctgttcttatagaaggttaagtgcttatgcttctcactgtggaaagttggagggcatcattctagctttatattaatagatgggaaaaatatatatactgtggtctttggagttgtcctgaataaacaaacctttaaacacattttctgaaccggcataaattccaaggaggtaggtctgtagcagatccactacggtagtgtagagaggaggaagggcacaggttatttttaaaaattagtgtttgactttggaatacttaaagaaaaatttggtttccatactatatttgattacactaaattaaaataagctttctttgtgcacacttctgtaggtggcaggaaaaatgctacctctttttttccctttttatttttatagaagccaatggtatggatatatcacagtttaagtattgccccactgatgaacattcaatttcattccttcaaaaactgtagagtcctaccatgtagcagacattgtactaggccctctggttatatagttatgaacaaaacagatgaattcttatggtgctcacagtcttatgtaggggttatgataataaaaacaaaagaaaacagtgtatcaggttgtttcatgatttttaaaaataatgatgctctgtgaacttccttgagtaaatctcactgtatcacgggtagctcaaactcactttcccaaaattgaacttagcatccatgaaaccaatcctgctgggtccagtggcatgtgcttgttgtcctaggcacttaagaggctaaggcaggaggagcacttgaactcaaagttcaaagccagcttgggcaaccctgtctcaaaaacaaataaacaaaaaacaactcttcaggtactcagatctctgtgttatttcttttctttttctttttctttcttttcttttctttttttttttttttttttgagacaggatctcaatatgtcgcccaggctggagtgctggagtgcagtggcatgatcacggctcactgcagccttgatctgggcccaagccatcctcccacctcagcctcccttgtagctgggaccacaggcaaatgtcatctggttcgctaaggtggatgtctgcctagcttagccctcaagcttctagaatagcccctttcaactaggttccatgagaattaatttcttttttttttttttgagaccggagtctcgctctgtcacccaggctggagtgcagtggcacaatcttggctcactgcaagctccgcctcccgggttcacgccattctcctgcctcagcctccccaggagctgggactacaggcgcctgccaccacgcccggctaattttttgtattttttagtagagacgggatttcaccgtgttagctaggatggtcttgatctcctgaccttgtgatctgcccgcctcggcctcccaaagtgctgggattataggcataagccaccgcgcctggccaagttcttttttttttttttttttttgagacgtagtctcgctctgtcacccaggctggagtgcagtgttgtgatctcggctcaccgcaacctccaccaatcgttcaagcgattctcctccttggcctcccaagtagctggattacaggcacatgccaccatgcctgggtaatttttgtagaaacagggtttcaccatgttggtcaggctggtcttgaactcctgacctcaagtaatctgcccgcctcagcctcccaaaatgctggaattacaggcataagccaccgtgctcgcccagaattaagttctaatgccctttttttttttttttttttgagacggagtcttactctattgcccaggttggagtgcagtggcgtgatctcggctcaccgcaacctctgcctcccaggttcaggcgattctcctgactcagcctcccgagtagctgggattgcaggcatgtgccaccacacccagctaatttttgtatttttagtagagacgggatttcaccatgttggtcaggctagtctcaaactcctgaccttgtgatctgcccacctctgcctcccaaagtgctgggattacaggcataagccactgcacccggtccaggtgaaacatttcaaacatggctcagtaaatattgcctgattctcccaagcagtcttcaacactcacatatcttccactctctcccttgtttatgattctcagctccagccaaaagggccagttggtttcttagccatgctatgtacatatttgaatttttgccttccaggaagagcatccattcctctctgcttgtttgagtcccacccttaaagttagtcaagtccagcttttcccctagaggttattcccacttttaggttatgtcctcacttctgttcatgctgtctggcacataattcagcttttggcacaagtggtgctcagtgcttggtggtggtgttgacaattgaggctgggggccaagacaggaagttcttgggacatttgggctcctgggtattgtcttaagggtctcttttcccaacagaggtcccccctattggaagtaaaggggaacatagaactgaagagacctctgattaaggccccttcccagctgcctctctcaggaagcagactcaagaggaggcctgaccagatggaagatggcctggagcctgagaaggtgagctgggcatggagagctgtgcatgtgtgtggggggtgtgtgtgtgtgaaagaaaggagagagagagtataaaccattagggagggtgactatggaccttgtctttatctttccccagaaacggacaagaggcctgggtgcaacgaccaaaattaccacatcccacccaagagttccatccctcactacagtgccacagacacaaggccagaccacaggtgggctctcaggatggatagactccaaggacatggaagtccagtgctcttcaactcacttgtttcttttctttcaattttattttattttttttgagacagagtctcgctctatcgcccaggctggagtgcagtggctcaatctcactcactgcaacctcctcctcccaggttcaaacgattctcctacctcagcctcccgagtagctgggattacaggtgcccacaccatgcccagctaatttttgtatttttttcagtagagatggggtttcgccatgttggccaggctggtcttgaactcctgacctcaggtgatccacccgcctctgccttccaaagtgctgggattataggtgtgaggcaccgcacccagcctattttgaataggtaataacatttcatttggttcaaaattccaaaggcacaaaggttgttgtatagtgaagtttgcttcctatttctgtcctccagccacccaattctgctacccagggcaactgtgtgttcttccagggaaattctattggtattcaagcaagtaagactatactcccccaccttttttacataaatggtggcatactttagacatggtcctgcttttacttatcttaatccaaattgctttttggcatatggagtacagttggccctctgtatccgtgggttctgcttctgcagattcaaccaaccatcggttgaaaatattcaaggagagtgggcacagtggctcatgcctgtaatcccagcactttggggggccaaggtgtgtagattacctgaggtccggagttccagaccagcctggccaatatggttgaaaccctgtctctactaaaaatataaaattagccagacgtgatggcccgtgcctgtaatcccagctactctggaggctgaggcaggagaattgcttagaacccaggaggtggaggttgcagtgagccgagattgtgccagcctggcgacagagcgagactcggtctcaaaaaaaaaaatgagaaaatattcatggaaaataaaaaataaaaccaaaaaatacagtataacagttatggtcatgtgtcacttggcaatgcagatacattatcagaaatgcattattgtggaaacatcatagaatgtacttactgaaacctagatgatctagcctgctacacacctaggctatctgcgatagcctattgttcttgggcaacaagcctgtgtggcgtgttactatactgaagcatggtaggtaacataacacagtggtaaccatttgtgtatataaacatacctaaacatagaaaaggtacagttaaaatataatataaatgataaaaaatggcacacctgtacagggtactaaccattaaatggagcatgtttgaatggaagttgctctgggtgagttagtgagtgagtggtgagtgaatgtgaaggcctagggccttactgtacactgctgtagactttagaaacatggtacagttaggctacatcaaatttataaaaaatagttcttttataataaattaaccttagtttactataactattttactttataaacttaacattttttttcccacttgccaaggctgatgtaacattttaatctttttttaacttttttttttcgaccagttgtcaaatgatcctttattgaaatattttcctttgtgcttaactagctgggcattccacagcaccactgttgatgtcatctatgatgtcatgagggtggtggccatcaacattacagcccatagactgggcagtccccggaatctctttaatggttccagagagttctctggctaaggatcggtgccgcatctgtcgagcaatgttgacgatctcatcaaaagtgatattcccattgtgtttaatgtttttctgtttctttctgtctcttggtggtttcttgagggctttgatgatcggggcagaggcagaaggcaccacctcaatctgggcctgtctgttctcaatggtcagtttcactgtaatcctcaggcccttccagtcacccgttgccttggcaatgtcatcaccaaccttttttggagacagacccagggggccgatcttgggggccagggcagaagtggcaccgacttcacctctggtgcacctcaggtatacgaccttgatctcgttggggtcgaacttcggtggcatggtggaggcagctggtgtcggatgaacccagattcaggatgaccgaagaaagttgcaccttggcctcctccgagccgaaagccgagagcttctctctcttttttttttgagatggagtctcgctctgtcgcccaggctggagtgcagtggcacaatctcggctcactgcaagctccgcctcccgggttcccgccattttcctgcctcagccttccgcgtagctgggactacaggcgccctccaccacacttggctaattttgtttttttgtatttttaatagagacagggtttcaccatgttagccaggatggtctcgatctcctgacctcgtgatctgcctgcctcagcttcccaaagtgttgggattacaggcgtgagccactgcgcccggctaactttttgactcttgtaataacaactgaaaacacaaacattgtatagctttacagaaatattttattcctttatatccttattcctcatgctttttttctatctaaattttgttttgggcggggagcatatattcagggcaatatgaatctctgtctcctggcttgaaaataaaatttttgttttttgttttttgtttttgagacagagtctcgctctttcgcccaggctggagtgcaatggcgtgatctcggctcagtgtaacctccgcctcctgggttcaagtgattctcctgcctcagcctcccgagtagctgggactataggtgtgtgccatcatacccagctaattttttgtatttttagtagagatggggtttcaccgtattagtcaggatggtctcgatctcctgacctcgtgatccgcccgcctcagcctcccaaagtgctgggattacagacatgagttactgcgccccgcctgaaattctttttttaatttaaaattttatttatttgtattttttccaagaaataagcttaaatttgaaaaattttaaatattattttgcttttcaaactttttgttaaaaacgaagaaatatacacattagcctaggcctacatagggtcaggatcatcaacatcactggctttcacctccacatcttgtctcactggaagatcttcaggggcagtaacacacatggagatgtgacttcctgtgataacaatgctttcttctggattgcctttttttttttttttgagacggagtctcgcactgtcgcccaggctagagtgcagtggcatgatctcggctcactgcaagctccgtctcctgggttcacaccattctcctgcctcagcctccggagtagctgggactacaggtgcccgccaccacgcctggttaattttgtttttgtatttttaggagagacggggtttcaccgtgttagccaggatggtctcaatctcctgaccccttgatctgcccacctcggcctcccaaagtgctgggattacaggcgtgagccacagtgcctggcctggaatgccttttgaatgacatgcctgaggctgttttatagttaactgtttttgcaaatagaaggagtataccctaaaataacaataaaaagtacagtacggtaaatatataaactagtaacatagtcattatcattattaggtattatgtactatatgtaattatatgtgttatacttttatacaactggcagtgcattaggttcgtttatatcagaatcaccacaaacaggtgaggaatgctatgacattaccatggctataatgtcactaggcaataggaatttttagctccattataatgttacggggctactgttgtatatgcagtctgtcattgaccgaaatgtcattatgggcacatgactgtattaacatagcatttacattgtgttagatattataagtaatctaaagatgatttaaagtatatgcggctggatgtggtggctcacgcctgtaatcccagcactttgggaggctgaggcaggcagatcacctgaggtcaggagtttgagaccagcctggccaacatgctgaaaacctgtctctactaaaaatacaaaaaaaaaaaaattagccaggcgtggtggcgcttgcctgtaatcccagctactcaggaggctgaggcagaagaattgcttgaaccctggaggtggaggttgtagtgagctgagatcgcgccattgcattccagcctgggtgagaagagtgcaactccatctcaaaaaaaaaacaaaatggaggccaaggcaggcagatcaccagaggtcaggagtttgaggccagcctaatcaacatggtgaaaccccgtctttactaaaaatacaaaattagttgggcgtggtggcgcatacctataatcccagctactcgggaggctgaggcgggagaatcgcttgaaccctggaggtagagtttgctgtgagctgagatcatgccattgcacttcagcctggacaacaagtgaaactctgtctcagtcaatcaataaataaagtatatgggagcgtgtgcatagactatatttaatactatatacctatttatgtaagggacttgggcatccttggattttggtattcttggggggtgctggaatcaaccccttttggatactgagggatgactgtaatttctggttctaggggaggtatcattaggagctggccagacttagggataagggaaggaagttatcctatttctaattctgagaaaagcacttcttctgcccctgtcctagcaagtgtacatgccatcttaagaatgatcattctacctttgctctctcccatctcctgggcagctcaaaaagtttccaagaagacaggaccccggtgttccacagctattgccacaggtaactgtgctcaagagctgggtctgagaagggatttggggtatgtgtaaagggagaatgatggaggtggagggacactggtcctgtaattcctaagtcacctcctcaattctgtagggttgaagaaccagaagccagttcctgctgttcctgtccagaagtctggcagtaagtgacaaacataaccactgggtgagaggctgggatagggaagagaagatggtgagtgaccagaaaaatccatttggtctctaaggggaaggagatgtagcatcaggtgtggatcccataaaggctagaagggaggagggatagagagcctagacttcactgacctttgtcctttctgtgttcatcttagcatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggaggtaagggccagattttcaccagatgtcagccccgctttcctggcagaggtcatgcctcccctcccttccaggtacccctcaagtctgggctgagaactcctgagcacctatctttagcagtataggtgctgctgaagatacctctctcttgacctgtctgcaccccagcccactcctgactgtcttgctttctgccacgcttcttcctacccttgactgtttgcaaagctctcatttagatctgtgtctttcttagtcctccatccctctttctttgggttcccatcctgatcacaaattcctgtggtactctctttccctcctcccatgtccacttgactccttcctggtgagcaccaactagattaagttatttgcagtctcttaaatgactcaactttcacttctgggcattctgcatatgtgcttccctctttctggaatgttctttgtatactacatccttccttggttcactcctgtacttctgggtgtcaccctagatatcatcttccttgtgctcctctttgtgcttggacatacccatagcactccctgtcttagtaccatgattccttattttctcatctttctttgtttaccagactttgaggtccttttgagcagggacctcacttccacccactccatacgccccacagtttgttcttcttcttggttgcatcttaccctctgtgtatgttgtgttctcttctgggcagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtgaggacccatgggcactggaactgggaaatggggaggagtgggcagggtgccacgagatggaggtagagggagaaaggagcaagagagaattgaaggatgaagtgcaagttatcaggctgggttaccacatccggttttggcctgtgggctgtcggtagatctgccttaacctgggagtggcgagggagtgatgcatctgccaaaacgaggagggtcactacatctcatgtctcatcttcttgctcagctcatcctagccatgctggcctcctggctgttcctcaaccagctagtcgtgctccccatctcagggcctttgcctggatgctctttcctggagatcttggctatcctgtcaaaacttgtgttccccaccccgcctttatacactccctattctatgtattccttaccattttcagacatactgtgcatcttattttgtttcttgacaggctagaaagcttcaagagggtgggggtgggctcttattcatttccatacatattactatgtactgacttctgcctgcctttttgccccttctgctcccatccccaggtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggtgggaatgggagtggggtgagatacgggacctgggggacagttggggttggctgtgcagaaccctgcctattcctaaacatctgtccccacctcaatcatctaggagtcccacgtgccttaccggaacagcaaactgacctacctgctgcagaactctctgggtggtagtgctaagatgtgagtgaaagggacagatggaaggggtcaggtaggaactgtgttggggtgaggggtagaaaggggaacagtggagacctgtccaggctctgctggcccctaatgctggggttgggcacattgtcttttcataggctcatgtttgtgaacatttctccactggaagagaacgtctccgagtccctcaactctctacgctttgcctccaaggtgcgattaccacccgtcagccttgtcaggacccgtgggtggttgtaggcttctccattccaatcccttttgtcttctagggcagggagcacatttgtgcagaaaggttttgcaggtatctgaggcactgctcacctggttccatttttaattattagcttttgagttaagttttttaaaaaacgggtgattaatttaacctgagaaagctgattaaaaaaaaaagaaaaggtgactaaaaggtctaaactggttgggcgtagtagctcatgcctataatccgaacacttcgggaggccaaggcaggaggattgcttgagcccaggagtttaaaatcagtctgggcaacatagtgagaccctgtctctacaaaaaataggaaaattagctgggtgtaatggctcacacctgtagttccagctactcaggaggctgaggtgggaggatcacctgaacctgggaggtggaggctgcagtgagccgtgatcctaccactgcacttcagcctgggtgacagagtaagaccttgtctcaaaaaaccaacacacaaaaaatccctaagattcctccctatcagcatacagagatcattatttttaggtctgcctagactccactatgtagctgcaccaaaatttatccaccagttccctctactggacacttggattgtttccacacttttttagtcacaaacaaggccacgttgactaactttgtacatacatcattttgtatttttcagttacatctaactagggaaatagtccttgaaatgggattactggatcaaagacttagaggtttttcagactattccaaatagtgtgaattcagactccaaacctcatgagggtcagccagtggctatatgaattctcactaatgagaattccttccactagaatctccttccactagtgttaagcaagtcagaaagtttccttactgtctgcctccacagtaatttttttctctggtacaccctcctcctgcgcgtatagccctttgatgggctctggctttatttgaggtctgatcaggtctgtcctgctgtgcgcttgggcctcctcccagtcagcactgattgttgctgtggagtagccagcacctgcaccctgatctggtattctactttgatgagggtttccctcactatcttgcaagttcaattttagagggtggtgatgttttttctaactttttattaatgttataccaatgtaacatccaacaacatgaactttaatatcctctaatacccagtttatgttaaatttcacccaactgtctcagaagtgtcttttatacataataggtttgttcaaatcaggatccaggcaagggccacccacttggttgaaatgtctcaagttccacaaccctatcccacactgccactattatgtcgtttgttgaaggtcatttgtcctatagaatatactattctggattttggctggttgcttcctctttcccccatactttcacttatttatcatatttgggtgttgtcaacctgacccatccatttacaagctccttattgactttttcacctagtgattttatccagcagtgaccatacctggatctttatttcattaaggggtttctaaatggggatttttctaatcttagttgttctgcattggttagtcacgattcttttatgaagacatttgccttgccatctacttggtttctctgaaattcaattcatacaggaaaaacaagataaatgctgaattatttattgattttcagtattgagttgatatcctagcagcttccaaaggtgaccaatgaatgtttatctgagggttatttttatttttattttttttgagacagggacttgctctgttgcccagactggaattcagtggctcaatcatagctcattgtagccaccaaaagtgttgggattataggcgtgagccacccagcccggccacagtcgttcttctttctgatgctcaaattgccccatctttagccaataggaacctcctggccgggcgcggtggctcatgcctgtaaccccagcactttgggaggctgaggtgggtggatcacgaggtcaggagatcgagaccatcctaacacggtgaaaccccgtctctactaaaaatacaaaaaattcaccgggcgtggtggcgggcgcctgtagtctcagctactttgggagtctgaggcagaatggcttgaacccgggaggtggagcttgcagtgagccgagatcgcgccactgcactccagcctgggcgacagagcaagactccgtctcaacaacaacaacaaaaaaaagagcctccttcagattggtgccagtgtcctttagacagaactctagtagtcttttcagattcaacttgtacatttccttccccagacttcaactgatccattttctaaggagtcctagttcctaaatgggtgttattactattttatctcggtttaagtgttttacagtgggagaggttggaggtctctagtacagggtattgctggaaatgaaagcctcctttctctgctcctgtattttcttctggggcttccatctcttctcaagccttttcacctcctccaaacctagtgtgcagaggagaacaaaccataactggcaccagcctgaaccagcctttggaggccttatttcggtatttctgagggcagccctagcattggaggatgggagatcttgggaaaaatgttgtattggttacgctgcaaacttttatcctgtctaaccccctgcccccaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcaccgccttgggtcctcgcgcccttcgtctgcgccagccctggaagcacggggcgggacgtccacgggaagcggcgcgcacgcccgccgactccctcgcgccaaccgccgacggccgccgcccggtgaaggaggggctcagtcctcccaggtgccgcgcgcaggaggggacacgcgtgcgcaaaagggcggtgggtggggcgcgactcgtcacggggagggcggggcgcgcgagggaggagggcgtggtgggggcatcgagaagggtgaatggagggcggggctgtgaactggggccggggggcgggacttggagtgaccatggggggtggggcagctaacggatgtggcatggggcgggggaccaggccggaggcgggctgccgggaggggggattccctcgtgccccaagggcgaatctcaggtcggaggaaggggctgaggggattccctctcccaccgggtccgactcttcgctccccaagccgcggagggccagcctcttcttcggcgccctccaggcctgttggaggtgagggaggtggggtgaggtggtgcccgcccccccctccggctcctcctttcccccagtcctcccctcccaccaccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggtaaggaggcggcaggaggcgctggtggggggcagggagccgggggtcggcgcggggcgcgggcgggagagcctcgccgccttggcctcgggtccgggctgggccgacacaagtcccttctcggacttgccgtcctggggagtagagaccgggactgggacacgcccccctcccggggcactcagagaagttgtctaacccgggggcagggagccccgaatttgagggtgacctgacataacctggcaccaggatgattgttcttaatgagacgcgcaggcctggggagacagccgtttctgctctggaaaacatctccagaaaaggtcccaaaacacgtctctgggcaacaggacaccctaattatgatacctctaaactgagtagcctttgcttctacaaccataatttctcctaaaatttcaaggccagtatataatatcccaggagagctctggaagctgggaaactagcaactaggtttggggtcggggggagggctgttagttaccgagaggagagccagtcactagagttggaagaggactcaaaaagctggtgatgggtgcccagtggtttcctatcaaggtgtctcagggatttggagatgggggcacagatacttcattcttgatggcaaaataggcaaagaaaatggggaggctggccgggcccggtggctcacgcctgtaatcccagcactttgggaagctgaggtgggtggatcatgaggtcaggagttcgagaccagtttggccaacatggccaacacctcatctctactaaaaatacaaaaattagccaggcatggtggcatgcgcctgtaatcccacctacttgggagactgaggcaggagaattgcctgaacccgggaggtggaggttgcagtgagccaagattgtgccactgcactctggcctgggcgacagagcaaaactccatctcaggaaaaaaaaaaaaaaaagaaaaagaaaatggggaaggtttctcagcattcataaccttctcctccccatttcttttctggctaggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtaagaccttctacctctgaccttcttcctagttcccttatctaattctggttcccatttcatcctgtttgctcacccattccaggtggacagtgctagggaggtgtgtctggtccagtttgaggatgattcgcagtttctggttctatggaaagacattagccctggtaagactctagagacctgagattgcacatcccatggaaaacaaacctggcctagaggggcagaaagagacttaaaggcaggccctgtgacactgtgttctctcacagctgccctccctggagaggaactcctctgttgtgtctgtcgctctgagactgtggtccctgggaaccggctggtcagctgtgagaagtgtcgccatggtgagagggcaggtcacctgaatggtccagcttgctcttccctccaggatggtctctatatcacctgtcctggccttagtccccaagccactgctctggccaggctgcttagccttatcttagtcctcatccgctttcagcccagggagaagcagccatggaaaggggtggtataacctttgcaggcagaagatggtttaaatgcatccttttctaaccatatgacctcggacaagtcccttaacctctaggagcctcagttccctgacttgtaaaataaggataatgcaccccctcatcaagaccatggtcagggattaaatgagatgggtaaagactattcctgtcccaataccaagcacacacaggtatgcaataagtggtctactattatcactgcagcttatcaccaggactgccatgttcccagggctccagcccctggagagggagagggcacatcctgggtatgccgccagtgtgtctttgcgatcgccaccaaggtaaaggcacttccctgttacccttcctgtgggagcctcccatccacagcctctcccaagccttttcctctccccacccctctgaagccacccacctgtcctgtctctgcagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtgagtaatgagaggggagcagactgtggaatgaatgatgtggtggtggatcccaggaaatgaaggaaaaagaacaggatgagggtagcactcagggggataggaggtaagtttagggtttgggacagttatggggaagggggtttctggaggccagaagtcctgtgttccccctcaggtggaacctgaaaatgctgcagtgccggagctgcctgcagtggttccatgaggcctgcacccagtgtctgagcaagcccctcctctatggggacaggtgagaccaaggcagactctctaggagccaaggatgccctctttcttcgtgttccaccctcagttctcccacgcccttctccactccagtctcttcccaacctctgcagcgttacctcacctgtttgccccgtccttgcttgtgagtcttccaggggatggcacagttttcctgtgtaagtgtgtttgctccctcttgcccatgtccaggttctatgaatttgaatgctgtgtgtgtcgcgggggccctgagaaagtccggagactacagcttcgctggtgagctggattgggcatgacctcagtgtaactccacaccacagtatttcactctatatgccccaacctcccacctcaggactcccctggctcttaaaatgcctctgtggtcttgaaaactttgtttttccagggtggatgtggcccatcttgtcctgtatcacctcagtgtttgctgtaagaagaaatactttgattttgatcgtgagatcctccccttcacttctgagaattgggacagtttgctcctgggggaggtaaggggtagtgcagttttgggggttgggatgggacagggagatgtagcggaaaggggaagagaagaaatcactgctcccctggccccatttttcttcatttctcccagctttcagacacccccaaaggagaacgttcttccaggctcctctctgctcttaacagccacaaggaccggtgagttggagggaagaggaggcaaggatgaggctcggaaagagatggagagtggaagcctggaaggggaggggcttgcaacccacctggaagactgtgactgaaaaggattgaggaatggcgtaaggaggaaccgttttttacagcactgaccctatatcatttctcttcttgccccagtttcatttcagggagagagattaagaagaggaaatgtttgtttggtctccatgctcggatgcctccccctgtggagccccctactggagatggagcactcaccaggtcactggtccaggggggatgggggaaattctcagggtgttagtcctggggggtatatgtatagagatggggaggtcttgggggtgtccgggagggggctggggggataaggaggcctcttacagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggtactggagcagggggaacccgatggagcaaatggtggggtgtgggaaggagtcaaggattatctctcagtcctttgccccctcttctaggcctcagtgtctccaccatcccccagccctaaccagagttaccagggcagcagcggctacaacttccggcccacagatgcccgctgcctgcccaggtcagtgctcctctgcccctcccccacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccctggatctttggtgtccttcattactggggttttactgaccctctcagccatgctcccctgctgactgccagccccagtcatgggcctaaggcctcccaccccatccccctcagggggctcctgctcaggttccttgccccctccttcccgctgccagcctctccgccgtcgctgctcttcctgctgctttccggggggtaggtgaggccggagctgaggggcagagggaggtgggggcatgcactggggtcaggggtgggaacctgggttaacagcttcccttctggccccctccccaacttcccttctggccatttcctcccctccagaataccacttgggtcgctcgaggaggaagagtgtcccaggggggaagcagtacagcatggagggtgcccctgctgcgcccttccggccctcggtgagtggtgcctaccagatgtggctcagttgggccccctcccctccagccccaactggggccctaggagtctgagaaagagggcaggagggggagagagggagtgagagtgagaaaaagagtgtgtgtctgtgtgtgtctccccacctctttggtttcccccttcttggctctgcccccctgcttctgagaccagccctcccaccttctccaagctgtgtgtgtgtgtatatgtgtgtgtgtgtgtgcttgcactgtacccgtgggagcaaggaagacaaactggtattagggttcctatccccctttcctcgcctctggagacttcccttttccccatcccactttcatccaggggctctctaccagctgagggatgagtaggtagaactgaccctgccccaacccaccccatccccatttcccccccagcaaggcttcctgagccgacggctaaaaagctccatcaaacgaacgaagtcacaacccaaacttgaccggaccagcagctttcgccagatcctgcctcgcttccgaagtgctgaccatgaccggtacaggggctggagcatgtgggatgagattgatgtaatgtagggtctcctgtgtgagatgcagagggagggggttatctgtgtgcaaaggttgaaggattcaactcaagttggttgggggatgtcatggcacaggggacagaacagaaaagaactagaatagggatctgtgagcagcaggagaggggtagggtggcagagagaagacagacagacaggctggaaagggaatgaaggtgaagccaaggagggactcctcagggactcctcaggccaagaaggatgggctctagcccaggatcaaaggagctgtacaggaggagagtgaccctggaggaatgtttaaggaatgcagggaaggggttggtaggtgagtgagcaataggctgtaggtggaagggtgtcagggaaggtcaggaaatacaggggcagcaggttggagtggggctgggggtggctgaatgaatggatgatggctagggctcaaggacctcatcagtgagggaagagacagtatagagcatggcagagaaggggaggctgggacaggtgtgcagggtgacagaatgggaagcaacccatggactgaggcatgaagaagcagccagcggagaagtccagaaggcactgtccctgagaccaggctgaaggagacctccactgtttgcctttgttgcctgccatttggggttcctctctgggtttccccctcacccagtcactccccagggagaaccatgccctccctttcccccatgtctggccacccccaggattgggcaggtagggaggttgggataaagtgagtcacacctttccctgcccccctcccatgttgccagagctggatttggggccggcagggggtgagggcatggtattcctggccgcgggggcgggggggggggtccgggggccgggggagcgtcgcgctgacggcagccagagcctgcgatgacggggctgctataaataacttcttggaggctcccacacccaagctcccctcccgctttcccactgctctctactcttcatcccctgcccatctccataccgcttttgtattgctatcctacccctcattattccatgcccctagccccctttatcttctgccctcctgcagtgatttttttgcattccatcccctcttagccctcacctcggttctcccggccatctctccagttggccttcctcctcttctcctgtcctctgtcttgctgcacatacctttgtctccccctttcttcttcttgccctacctcctcttcttccctagtccgtgtattctgtcttttatcctctttgagctcttttctgcccacagctttctcctatttcttatgcttttccctcactctttcccctgcttctgctaaaacttgtcctcttatgctgtgttcattcattctttgaatcattaaatgtttatcaggcactagccgtgtgccaggcccaggctagacatatctcttctctgtgccttcacttctttacttccactttttcctttatactgaggctctggtttctggggttacctggaggtactacctagaagtgccccaggcccactttgttctctccttttttttttttcttttctgccatggtccatttctgggttgagatatttctagatgtccccagtcctcgcaatcccttaggtgtgagatggtgggagtttcttttttttcctttttttttttttaaatagaaatagggtctcactgtgttgcccagactggtcttgaactcctgggctcaagtgaccctcccacctcggcctttgaaatgttgggattacaggtgtgagccaccaggcccaggtggagcaggggagttccttaaaggattctgatttttctcacatccctcacgtccttcctgataggcagggtttctttctgtgtctgtttgggaagggtgttcagggggccttctctccaagtctccatcctggaacagactgatgatgcagggtacctatgtgtctaagaagagtaggggggccgggcgcggtggctcatgcctgtaatcccagcactttgggaggctgaatcacttgaggtcaggagtttgagaccagcctgaccaacagggtgaaaccccgtctcagctaaaaatacaaaaaaaaaaaagaaaaaaaaattagctgggtgtgctgaggcaggagagacgcttgagcccaggaggcagaagttgcagcaagccgagatcacaccactgtactccagcctgggcgacagagcaagactgtctcaaaaaaaaaaaaaaaaaaaaaaaaggaagagtgggaagccctgatcccttcctctcctgaacctcctgcctgccagggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtactgggtctggtgggctggggagggccaaaggacaggggtgatggaaggtggggggcagagaggtctagagaaagtggcacaggtggggacatcaaggaaacagaaacttctgggactggaggaaagggtaggccagggaggaagagaaggtagcagagtctcctcccctctgtagccctttccc

SEQ ID NO: 85 - DNA, 8963 bp, Homo sapiens
ttttaaaaacaggagagagaatgaggcaacagtaaaataaaccagaacacagccggagagagagaatcacagaactgtcgggaggcgccgcgagatggggggccgggaagggggcgcaggcggccgcgtctgaccgccctcgctctccctccttttcctttccttcctcccccgcaggagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggtgagaggcagagggagggggcgaccggggcggcccacctgggcgcgcacgtgtgtgtgtgtgtgtgtgtgtgtgtgtgcgcgcgcgcgcgtgagtgcaagtgcgcgttcgtgtgtctgcaaagccaccttgccccgagcacccccgggggcccggagccttcctaggcggtccccaagctccatcgccacccgctgggtaaggtgggtgtagttctcgcgtcgccttcggaggagtaaaccgacacaggcaggtgtctggcgcgtaagacgccgggcgcttaggatcccaagcccgccgtcctggagacggaaggggaggagctggggagggggtgggaccttgagacacaattgggctcttgaggatagagaggcggggctgggtcttggagggcgggcccaggagaggtagaaagtgatctgagcgccgatgaggagcctgctttaaggggcgggcctttggagactttggtggatccaagagggggctggtcctgggaaaccgtccagggccgggaagtggaaactaaaggggctgggtaagggagactgaatcggcccttgcccgtggccatttggagaaggagaggctagaaaagacggggcgatgcctggaaaagccaaagggggaggggttatgtccttaagggcacagagaatcaacctggctgattgaagcaagaggccgaccaaagccagtcagtacctgggattggccgtctcaagagctagggcctagacgagcagagagctaggactggaacacttaagaggcacgcaattaaggggtaaggccccctttctaccccgtatgagtagcattgggaaattccaggggcagagcttttttggaggagtagaatacagagaagagggagggctttgcatatttgaagagcagggtgtgctttggggatgggtctagatctgcaaggggtggggcttggaggatctgaaaggccggagtagctggacctgagaccggcaaggacccgagaccggcaaggaccctggccaagatccgcacggggcggggtttggtaagctggaggtggggcctagagtagaaggcggggcctgctttattaaaggcaaatttttgaccagtaggggagggcctagaatggatactccggcaggaattatatgaagagagattagataagtgaaaggcagggcctgatcacagcaggatgacatcattaacagagttcaaaggagcagagggatgaggcttgggaaaaacccaggtttataacgttaagggtggaggtagactaactagggcagggcctggaaactcatctcatcaaaggtgggttttagaccagtcagggcagggcctggactcgctgggagtggggcttaggccacctaggggtggggcctggaccgcttggggtggagttaccaccagccagggtggggtttagaccagcagagttgggaccttagctagaggagtggggtttatgccatgtgggggcagcccagaccatctgggggtgggtcctagaccacctggggcagagtttagaccagccagggctgggttagaccggcagaggtgggccgtgggctatctgggggcaggacctggaccatccagggccgtgtctggaccattcagggcagggcctggaccacctgggggtggaatttagaccatctgagggggtgcttgagcctgcctgggccaggaccacgcatgatgcagtctggaccattggcggccctacaccacctgggggatggagtttcgaccagccggggttggattagaccagcagaggtgaggcctgggccagctaagagtgggccggagccctctgggttggagcttagaccagcagggaagcgcctagagcatcgggcggggagttgtgttcacttctggcaggacttgggtcagccagatccaggacgggggtctagaccactcggggtggggcctagaccgcctgggggtggcgcctgggcccgctggcgcaggcgggcaggggtcggggccgggggcgggggcggggccgggggtggcctcgaggctcccgtctgaccgtccccgcccaggcctgagcaacatcatcggcgtgatcgtgtacatctccgccaacgcgggcgagccgggcccgaagcgggacgaggagaagaaaaaccactactcgtacggctggtccttctacttcggcgggctgtcgttcatcctggccgaggtgataggcgtgctggccgtcaacatctacatcgagcgcagccgcgaggcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtaggggcgcggcgggggagccgaggggcgtgtccggggcgcgtgcgcgggcgcgcgtgcatcgaggctgccggggtcgggggcgcccccgctttcccccgtgagcgcgctggagactgctgggcccgccccacgcccaccctccccgcccccctccccctccgaagcagggaccccgagggagggggcaggggagggagggggccgctgtgagggagcgtcgtgttttatttttttgggggatctatggggaggggggagggccatggtgttttttgcagtttcgagatgttttctttttcatgttttgctgtgtgcatggggggcggggcggggggaggggagggagggactcccagcccagcccaactcctggagaggggcccataatacacgaatacatagttacacccacaaactatatatatgccctatataaagagacacagcgaagggatgcagaaaggcagaaagaagggttggacgcgggcattcattcatttttttcattcattattccacaagggcttattaagcacctactgtgtaccaggcactggtacataagaaggcattggagcaggggacacgaacgaggcacagaaagggccttctcattcattcattcattaccggcaatttatttgtgcgccttaaaaagctaggcattgtgctccgtgctcagcgtgcaggaggcaggaaaacagccaggggccccgacgtctcatagagtaaacatcttgtgcatgagacaggcattaatcgatcatgtacatacacaataaattacagttaggctataggagaaacgagatgctatgaaatgctccatcaggggagcctaacccagttgtgaggaagagatttcagtggacagtgaaaggatgagaagaagccagcagggcggagctggggcaggagtgtggcaggcagagcagcacgtgcaaaggccccggggcaggaaggagcttgcagcgagggctgaagggtagtgaggcaggtgagcggggatcaaggtgaggccggagacacagacagggccagattgtgcaggggctcgtaggtcaggagttcagattttattctaggagtggtgagggccgtggaacgggtttaagcaggacgctaacgtgaatggtgtacaaagggaagacaggaactcggaggcaagagtaggaggcagagatgtgctgaaatacagcatcaaacatgggcacgggcccttggagctcacactcttgtgggaggaagcacgtaattacacagatgctgaagcatagtcatggtgtctggtgtgcaggagaaagccgtggggcttagagactcatgtgtctgtcactcgttcattcagccactcacccattgccatttttggccatctgctaaggtaccaggaagtgtgttaggatccagatccccaggggtgaaacagactctagccctgctctcaagcagtttattgtcatcaaacaccgccatccaggcagggcaatcggtgctggaacccggaccaccgtgggtaccgtggcacacggtggacagagtgaccaactgccaggagtgagcagcacttggggtaggcttcctggagaatatgatgcccattctgggtcttgaagaaatgagtgggcatcttctggttgatgaaaggcatgagaaaggcttgtggggccaaagaacaacttgggtgaaaacgggaggaagtgaacgagcatgatgtattggggtcagtgctaacagttctgggatgctgatgtacaaggtggggctgggagatgaggccgggaaagtagccacaagctagagtgtaaaggtaccagggtggccgggcgcggtggctcatgcctgtaatcccagcgctttgggaggctgaggctggagtatcacttgagcccaggagtttgagaccagcctggataacatggcgaaaccctgtctctacaaaacattaaaaaaaattagccgggcgtggtggagcacacctgtggacacagctactcaggaggctgagggaggaggaccatttgactccaagagttcgaggctgcagtgagctaggatcgcggcactacactccagcctgagcaacagactgagatcctgtctcagaaaaaaagagaaaaaggtgcctgagttccaggcagagggactgaggctcttctaaggatggtgagagaggatgacagctgcgcgggggcaagggctgtgcggtgattggaggggatgggtttgaagttcactgagaaggcagaggggacagcgcccagtaggcttcccttccatatttgctcagcaagtgtttcctgaggcctcccccgaagccttgtgctgggcggtgctgggagtggagaggtgattttgatcttgccctgctctcaaggggctcccagtctggcgggaaaacaggcacagacgcagcttgaggaggacgtggcagcggtggtgccatgctgccaggggctctgcgtgcccttctcttgacggaagggtacagatcagagctgggtgttcagaatttctctccgaggcctgtgtggaaggaccaggaagagagagactgaaggtccctaggaagaattctgccaaggcggtttcaggaagagatgctgggaaatgtaggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctccagcctgggcgaaagagcgagactctgtctcaaaaaaaaaaaaaaaattgagagacagcaaatatttgctggaagagggagagggaactggttaggggagaatggattctagagtctgaaggccaaacagaacgagagagagagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttgcagtgagctgagatcgcgccactgcactccagcctgggcgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaaaagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggctggagtccagtgggctgatctcggctcactgccaacctccgcctcccaagttcaagtgattctcctgcctcagcctcctgagtagctgggattacaggcatgtgccaccacgcctggctaatttttttgtatttttagtaaagacgggatttcaccgtgttggccaggccaatctgaaattcctggcttcaaatgatccacctgcctcggcctcccaaaatgctgggattacaggagtgagccactgcgcccggcctcatatttttatttaaacaagaacagcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggtggtgcacacctgtaatcccagctacttgagaggctgaagcaggagaatctcttgggcccaggaggcagaggttgcagtgagccaagatcacaccactgcactctagcctgggtgacagagcaagactctgtctcaaaaaagaaaaaaggtaaaaaaaaaaaaaaatgaccctgaaaggaagtaggga

SEQ ID NO: 86 - DNA, 1211 bp, Homo sapiens
gtgtgatcgtgtgtttgcacttactttctctttctccacaaagtccacaaaagcggtcctttcaatctccaccggctgcccctgcctatcgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcggcgctcggggcttggcggcaggcggctgccctggccgccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagagggtgacgtcggggggcggtgcctgcgccatatatgggagcggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaagga

SEQ ID NO: 87 - DNA, 9138 bp, Homo sapiens
attctattcgatcatcctcagcaaatttagctagcatagtttttctaaagttctcctcttcctcttttgcagcctgtagcactaattccttcaaggccatttgttcttcaaaatcttgcttcatctctttttgctttctcaatttcttttctgcttcttcctaaacaatacagctgaaagttaatttagtaactatttccttacaccagatttataaggaaagagtgatagagtttggttaaatttagtattacaatatgaaatcatacaaactgaaaaagtaaggcttttcatgataactttgtccatccctttaaaactagctggataaagaatatgcttacatttggattgttttctgttactcatgaacaaattttaatttatatttaccatcttgtttctctactcagaattaacacgtaactgctttggaaagagctgttacaaaagccttttttgcacacctgagtttattcatctaaagtctatggtaactatgaatcattctagaatcttgcttacaaaagctgtccaaaccacccataagtatttttcagtttccaacctcctcctcaaaatcaaagctgcacttacccatctctagtcttctaatattcccttcattctccaaaattctctaaaatttaaaaacaattatctagcaatgacaatcagtacttctttagggaaattcaaatatagttggaacagttaagtcctttcctataagcttttattttctgaacattttattatgaaaaatttcatacatactaaaaaatataattttacaatggtcactcacttctaaataattcatgggccaaagagggaatgccaaggaaaataaatacattgtagttaataaaagtgagacagcaaaatttgtgagatgctgctaaagcagttctgagaaacatttatagcactaaatggatacatttaggaaaatgtatatatatagcactaaatgcatgtatgtaggaaaagtctcaaatcgataatctaagcccccacttcaagaacctataaaaagaactgtaaagtaaacccaaaatatgcagaaggaaaaacataataaaactgtagaaatcaatggaattaaaaatagaaaatagacaattattggtgaaacaaaaggctggttcttaaaaattatcagtgaaatggacagacctttaacaaggctgacctagaaaaaaaaaatgaatgaataaacaaataactaatatcaggaataaaacataggatatcactagagaccctacagacatcaaaaggataatacaggaatactacaaattattatacacacataaatttggcaacttagatgaaatggatcacttccttgagaaacacaagctaccaaaactcaccaaatatgaaataaggtaatctgaatagtcctatcactattaaggagacggaattaataacttaaaattcctccaaaataaaaccccaagtcaggatggtttcactagaaaattctatcaaatatttaaaaaattaacacgaattctacacaatctcttccagaaaacagaagaggaggaaacatatccccattcattttatgaagatagtattaccccgctaccaatataaaaaattacagaccaatattcctcgtgaatatggatgcacaaatccttaacccaatattagaaaaatagatcatacattaaaagaattattcaccatgaccaagtagtgtttattacagggatgcaagactggttcaatactcaaaaatcaatgtaatatacttggctaaagaagaaaaagtcataatcatatcagtagaaaaaagtgtttaaccaaggatatccaggaattgaactcagttctgcaccaagcagacctaatagacatctacagaactctccagcccaaatcaacagaatatacattcttctcagcaccacaccgcacttattccaaagttgaccacatagttggaagtaaagcactcctcagcaaatgtaaaagaacagaaattataacaaactgtctctcagaccacagtgcaatcaaactagaactcaggattaagaaactcactcaaaaccgctcagctacatggaaagtgaacaacctgctcctgaatgactactggatgcataacgaaatgaaggcagaaataaagatgttctttgaaaccaatgagaacaaagacacaacataccagaatctctgggacacatttaaagcagtgtgtagagggaaatttatagcactaaatgcccacaagaaaaatcaggaaagatctaaaattgacaccctaacatcacaattaaaagaactagagaaccaagagcaaacacattcaaaagctagcagaaggcaagaaataactaagatcagagcagaactgaaggagatagagacacaaaaaacccttcaaaaaatcagtgaatccaggagctggttttctgagaagatcaacaaaattgatagaccgctagcaagactcataacaaagaaaagagagaagaatcaaatagacgcaataaaaaatgataaaggggatatcaccacagatccaacggaaatactaccatcagagaatactataaacacctctacgcaaataaactagaaaatctagaagaaatggataaattcctggacacatacaccctcccaagactaagctgggaagaagttgaatccctgaatagaccaataacaggctctgaaattgaggcaataattaatagcctaccaaccaaaaaaagtccaggaccagatggattcacagccgaattctaccagaggtacaaggaggagctggtatcattccttctgaaactattccaatcaatagaaaaagagggaatcctccctaactcattttatgaggccagcagcatcctgatactttggtcgtctgtcatcctgacagagacaccacaaaaaaaagagaatttaagaccaatatccctgatgaacattgatgcaaaactccgcaataaaatactggcaaaccaaatccagcagcacatcaaaaagcttatccaccatgatcaagtgggcttcatccctggaaggcaaggctatttcaacatacacaaatcaataaatgtaatccagcatataaacagaaccaatgacaaaaaacacatgattatctcaatagatgcaaaaaaggcccttgacaaaattcaacagcccttcttgctaaaaactctcaataaattaggtgttgatgggacatatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaagaaagggtattcaattaggaaaagaggaagtcaaattgtccttgtttgcagatgacatgattgtatatttagaaaaccccattgtctcagccccaaatctccttaagctgataagcaacttcagcaaagtctcaggatacaaaatcaatgtacaaaaatcacaagcattcttatacaccaataacagacagacagagagccaaatcatgagtgaactcgattcacaattgcttcaaagagaataaaatacctaggaatccaacttacaagggatgtgaaggacctcttcaaggagaactgcaaaccactgctcaacgaaataaaagacgacacaaacaaatggaagaacattccatgctcatggataggaagaatcaatatcgtgaaaatggccatactgcccaaggtaatttacagattcaatgccatccacatcaagctaccaatgactttcttcacagaattggaaaaaactactttaaaattcatatggaaccaaaaaaggggccacattgccaagacaatcctaagccaaaagaacaaagctggaggcatcatgctacctgaattcaaactatactacaaggctacagtaaccaaaacagcatggtactgctaccaaaacagagatatagaccaatggaacagaacagagccctcagaaatagtaccacacatctacaaccatctgctctttttttttgttacaaaaaagacaggtttgttacaaacctgacaaaaacaagcaatagggaaaggagtccctgtttaataaatggtgctggaaaaactggctagccataggtagaaagctgaaactggatcccttccttacaccttatacaaaaattaattcaggatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaacagccaacctacagaatgggagaaaatttttgcaatctacccatctgaccaaggggtaatatccagaatctaaaaagaactcaaatttacaagaaaaaatcaaacaaccccatcaaaaagtgggcgaaggatatgaatagacacttctcaaaagaagacatttatgcagccaacagacaagaacaggaaaggtgatgtctactctcatcactcttcttcaacatagcactagccagtggtgctggaaattttagccagcatgtaaggcaaggaaaggaagtaaaaagtatacagatcagaaaggaagaaacagcctgtagctctgggcagaagacatgcctgactatgtagggaaaaaaaatcctacagctaacaagtgaattcagcaaggttgtgagatacaagataaacacaaaaatatcaattcactagcaacgagtacacggacaccaaaataaaagctaacattccatttacgattgctcaaaaaatgaaacacttagatgtaacaaaacacgtacaggatttgtatgctgaaactagagaatcctgatgaaaaaattcaaagatctaaataaagggagagccaaattgtgttcatgaacttaatatagtgaatttatcaattctccccaaactgatattcaaatttaattcaatacctatcaaaatcccagcaaaaaatatttatagagacaagattcttcaaaaattcatatggaaaggcaaaggaactagaatagctaaaaaaaaaattttaagacttgccatatagctgcagtattcaaaactgtgtagtattggtggagggatggatacatagaccaacagaacaaaatagagaccacaggaatagacccatacaaacatgccaactgtgttttaagaaaggtgcaaaagcaattcaatgttggagaaacagccatttcaacaaatggtgtggaacaactgaactaaatccaatggcaaaaactgtatttaagtctcatcgtttgtaccaaaaattaactcaaaacagatcacagattgaaatgtaaaatggaaaagcataaaaaaaaaaaacccaaaaaaacaaaacacacacacacacacaaacctttaggaaaaaaaaaaggagaaattcttcaataactaggcgaagagtttctagagttgacacagaaagcatgatccataaaaagaaaaactgataaactgaacttcatagaaatggagaacatttgctctaagaaaaatcgtgctctaagatcatgttaaaaggatgagaagataaagctacagactagaagaaactatttgctaaccacccacctgacaaaggactagtatctagaatatatgaagaactctcaaaacccaacaataaatgaacaaacaacccaattagagaatcagcaaaagacatgaagaactatttcatcaaagaggatcttacaccaaagaggacagcaaataagcacatgaaaagatgttcagcatcattagtcatcaggaaaatgcaaaataaaactacaaggtatcactacatggatatttaaaagtggctaaaataaaaaattgttgagcttctgaggacagaggagaaaaaaattaaaaaataaactgtgttaacaccaaatgctggtgagaatgcagacagactgcgtaactcatatatttctgatgggaatgttaaatgctacagctgttctggaaatcactttggcagtctgttacacagctaacatgcagttaccacaaaacccagctaatacaatcttgagcatttattgcagagaaatgaaaattgatgtttatacaaaaacctttacctgaatgtttacatcagatttactcatcagagctaaatattggaagcattccaaatgccctttaatgggcaaatggtcaaataaaatggtatatacatgccaatggaatgttactcagcaaaaaaagggaacaaatgatcaatacaagcaacttggatgaatttccaggaaattatgctgaataaaaaaaagccaacttgaaaaagttacatattgtttgatatcatttatataacattcctgaggcacatacttttaaatttataattaaaggtttatccatgttttagcatgatcagtctgtcattcttttaatagctgaataacattttattacatggatatactatattttgtttatccattagacatttgggttatttctacttttgggttatttctacttttagactattgtgaataatgctgcataaacatttgtgtatgggtttgggtagacacaggctcattaatttttaaccattcttttttctaatatatgcatttaaagatataaactttcctctaagcactgcattaactgcacgtcacatattttggaatgctgttttttgaatcatttagtttgaaatatttttctaatttccaatattatttattccccttttctcattgcttatttagaaatatattgtttaattataatatatttaaggagtctgcaggtatattttcattactgatttttaatttaattccactgtagtcagaaaacatatctggtattatttaaaaccttgaaaatttattgagacttcctttatgtcctagaatatgatctatctcggtgaaggttccatgtttgaatggaatttgtgttctgctgttgttgggtggagtattctctaaatgtcaggtcaagtttattgatattgctttcaatacgatatcctgcggttctgactacctagtctatagattaatgagaactgtgcattgaaataccattctggacataggacctggcaaagatttcatgatgaagactcaaaaagcaattgtaacaaaaacaaaaattgacaagtgggacctagttaaactaaagagtttcttcacaggaaatgaagttatcaacagaataaacagacaacctacagaatgggagaaaatatttgcaaactatgcatctgacaaaggtctaatatccataatatctaaggaacgtaaacaaattaacaaccctatttaaaaaatagactggccaggcacggtggctcacacctctaatcccagcactttgggaggccaaggcaggtggatcatgaggtcaggagatcgagaccatcctggctaacacggtgaaaccccatctctactaaaaatacaaaagaaaaaaattagccgggcatggtggcgggtgcctgtagtcccagctacttgggaggctgaggcaggagaatggcgtgaacccgggaggcatagcttgcagtgagccgagatcacgccactgcactccaacctgggcgacagagcgagactcccatctcaaaaaataataataaaataaaataaataaataaaaagaaaaaataggctaagtacatgaacagatacctctcaaaaaatgatatatatgtagccaacaagcacatgaaaaagtgctcaatatcactaatcattagagaaatgcaaaccaaaaccacaatgagatactatctcacatcagtcagaatggctattaaagtcacaaaagaatggatgctgacaaggttgtggagaaaaaggaatgcttatacactgttggtgggaatgtaaactagttcaaccactgtgaaaagcactgtggcgactccccaaaaaatgaaaacagaattaccatttgattgctgggtttatacccaatgggattgctgggtatatacccaaaggaatataaatcattttaccataatgacacatgcatgtgtgtatttatagcagcactattcacaatggcaaagatatggaatccacctagatatccatcaatggtggactggataaataaaatgtggtacatgtacaccacggaatactacacagccataaaaaagaacaaaatcatatcctttgcgtcaacatggatggagctggaggccattagcctatgctaattaatgcagggatagaaaaccaaatactacatgtcttcacatacaagtaacagctaaatattgagtacacgtggacacaaagaaggaaaacagacactggggcctacttgagggtagacataggaggagggtgaggatcaataaactacctatcgagtactatgctcattacttgggtgacaaaataatgttacaccaaatccccatgacccacaaatttacccctgtaacaaaccagcacatgtacctcctgaacctaaagtaaaagttggaaagagaaaaagaaaaaaaaaaaaatcttgaactctgattgtggatttgcctctttctcctttcagtttttgtcagttttgcttcatgtattgtgaagctttattatttaggttcacacgcctttaggactatgacatcttctagatgaatttactgtattatcatgaattgcttgtcctgaagttgactttgtctcatattaacgtagcaactccaacctacttttgactagtgtctgtatgttacgtatctttcaccatccttttgcttttaaagtatgtatcttcatttttaaattgtgattacagacaacatagttgcatcatgctttttatggtaagtttataaattgatgcctgagtctatctttttagccagcttgaaaatttctgtcttttaactgtagtataccatttacatataatgtaattaccagtatggttggatttaaatgtactatctcttttctgcttc

SEQ ID NO: 88 - DNA, 9932 bp, Homo sapiens
attctattcgatcatcctcagcaaatttagctagcatagtttttctaaagttctcctcttcctcttttgcagcctgtagcactaattccttcaaggccatttgttcttcaaaatcttgcttcatctctttttgctttctcaatttcttttctgcttcttcctaaacaatacagctgaaagttaatttagtaactatttccttacaccagatttataaggaaagagtgatagagtttggttaaatttagtattacaatatgaaatcatacaaactgaaaaagtaaggcttttcatgataactttgtccatccctttaaaactagctggataaagaatatgcttacatttggattgttttctgttactcatgaacaaattttaatttatatttaccatcttgtttctctactcagaattaacacgtaactgctttggaaagagctgttacaaaagccttttttgcacacctgagtttattcatctaaagtctatggtaactatgaatcattctagaatcttgcttacaaaagctgtccaaaccacccataagtatttttcagtttccaacctcctcctcaaaatcaaagctgcacttacccatctctagtcttctaatattcccttcattctccaaaattctctaaaatttaaaaacaattatctagcaatgacaatcagtacttctttagggaaattcaaatatagttggaacagttaagtcctttcctataagcttttattttctgaacattttattatgaaaaatttcatacatactaaaaaatataattttacaatggtcactcacttctaaataattcatgggccaaagagggaatgccaaggaaaataaatacattgtagttaataaaagtgagacagcaaaatttgtgagatgctgctaaagcagttctgagaaacatttatagcactaaatggatacatttaggaaaatgtatatatatagcactaaatgcatgtatgtaggaaaagtctcaaatcgataatctaagcccccacttcaagaacctataaaaagaactgtaaagtaaacccaaaatatgcagaaggaaaaacataataaaactgtagaaatcaatggaattaaaaatagaaaatagacaattattggtgaaacaaaaggctggttcttaaaaattatcagtgaaatggacagacctttaacaaggctgacctagaaaaaaaaaatgaatgaataaacaaataactaatatcaggaataaaacataggatatcactagagaccctacagacatcaaaaggataatacaggaatactacaaattattatacacacataaatttggcaacttagatgaaatggatcacttccttgagaaacacaagctaccaaaactcaccaaatatgaaataaggtaatctgaatagtcctatcactattaaggagacggaattaataacttaaaattcctccaaaataaaaccccaagtcaggatggtttcactagaaaattctatcaaatatttaaaaaattaacacgaattctacacaatctcttccagaaaacagaagaggaggaaacatatccccattcattttatgaagatagtattaccccgctaccaatataaaaaattacagaccaatattcctcgtgaatatggatgcacaaatccttaacccaatattagaaaaatagatcatacattaaaagaattattcaccatgaccaagtagtgtttattacagggatgcaagactggttcaatactcaaaaatcaatgtaatatacttggctaaagaagaaaaagtcataatcatatcagtagaaaaaagtgtttaaccaaggatatccaggaattgaactcagttctgcaccaagcagacctaatagacatctacagaactctccagcccaaatcaacagaatatacattcttctcagcaccacaccgcacttattccaaagttgaccacatagttggaagtaaagcactcctcagcaaatgtaaaagaacagaaattataacaaactgtctctcagaccacagtgcaatcaaactagaactcaggattaagaaactcactcaaaaccgctcagctacatggaaagtgaacaacctgctcctgaatgactactggatgcataacgaaatgaaggcagaaataaagatgttctttgaaaccaatgagaacaaagacacaacataccagaatctctgggacacatttaaagcagtgtgtagagggaaatttatagcactaaatgcccacaagaaaaatcaggaaagatctaaaattgacaccctaacatcacaattaaaagaactagagaaccaagagcaaacacattcaaaagctagcagaaggcaagaaataactaagatcagagcagaactgaaggagatagagacacaaaaaacccttcaaaaaatcagtgaatccaggagctggttttctgagaagatcaacaaaattgatagaccgctagcaagactcataacaaagaaaagagagaagaatcaaatagacgcaataaaaaatgataaaggggatatcaccacagatccaacggaaatactaccatcagagaatactataaacacctctacgcaaataaactagaaaatctagaagaaatggataaattcctggacacatacaccctcccaagactaagctgggaagaagttgaatccctgaatagaccaataacaggctctgaaattgaggcaataattaatagcctaccaaccaaaaaaagtccaggaccagatggattcacagccgaattctaccagaggtacaaggaggagctggtatcattccttctgaaactattccaatcaatagaaaaagagggaatcctccctaactcattttatgaggccagcagcatcctgatactttggtcgtctgtcatcctgacagagacaccacaaaaaaaagagaatttaagaccaatatccctgatgaacattgatgcaaaactccgcaataaaatactggcaaaccaaatccagcagcacatcaaaaagcttatccaccatgatcaagtgggcttcatccctggaaggcaaggctatttcaacatacacaaatcaataaatgtaatccagcatataaacagaaccaatgacaaaaaacacatgattatctcaatagatgcaaaaaaggcccttgacaaaattcaacagcccttcttgctaaaaactctcaataaattaggtgttgatgggacatatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaagaaagggtattcaattaggaaaagaggaagtcaaattgtccttgtttgcagatgacatgattgtatatttagaaaaccccattgtctcagccccaaatctccttaagctgataagcaacttcagcaaagtctcaggatacaaaatcaatgtacaaaaatcacaagcattcttatacaccaataacagacagacagagagccaaatcatgagtgaactcgattcacaattgcttcaaagagaataaaatacctaggaatccaacttacaagggatgtgaaggacctcttcaaggagaactgcaaaccactgctcaacgaaataaaagacgacacaaacaaatggaagaacattccatgctcatggataggaagaatcaatatcgtgaaaatggccatactgcccaaggtaatttacagattcaatgccatccacatcaagctaccaatgactttcttcacagaattggaaaaaactactttaaaattcatatggaaccaaaaaaggggccacattgccaagacaatcctaagccaaaagaacaaagctggaggcatcatgctacctgaattcaaactatactacaaggctacagtaaccaaaacagcatggtactgctaccaaaacagagatatagaccaatggaacagaacagagccctcagaaatagtaccacacatctacaaccatctgctctttttttttgttacaaaaaagacaggtttgttacaaacctgacaaaaacaagcaatagggaaaggagtccctgtttaataaatggtgctggaaaaactggctagccataggtagaaagctgaaactggatcccttccttacaccttatacaaaaattaattcaggatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaacagccaacctacagaatgggagaaaatttttgcaatctacccatctgaccaaggggtaatatccagaatctaaaaagaactcaaatttacaagaaaaaatcaaacaaccccatcaaaaagtgggcgaaggatatgaatagacacttctcaaaagaagacatttatgcagccaacagacaagaacaggaaaggtgatgtctactctcatcactcttcttcaacatagcactagccagtggtgctggaaattttagccagcatgtaaggcaaggaaaggaagtaaaaagtatacagatcagaaaggaagaaacagcctgtagctctgggcagaagacatgcctgactatgtagggaaaaaaaatcctacagctaacaagtgaattcagcaaggttgtgagatacaagataaacacaaaaatatcaattcactagcaacgagtacacggacaccaaaataaaagctaacattccatttacgattgctcaaaaaatgaaacacttagatgtaacaaaacacgtacaggatttgtatgctgaaactagagaatcctgatgaaaaaattcaaagatctaaataaagggagagccaaattgtgttcatgaacttaatatagtgaatttatcaattctccccaaactgatattcaaatttaattcaatacctatcaaaatcccagcaaaaaatatttatagagacaagattcttcaaaaattcatatggaaaggcaaaggaactagaatagctaaaaaaaaaattttaagacttgccatatagctgcagtattcaaaactgtgtagtattggtggagggatggatacatagaccaacagaacaaaatagagaccacaggaatagacccatacaaacatgccaactgtgttttaagaaaggtgcaaaagcaattcaatgttggagaaacagccatttcaacaaatggtgtggaacaactgaactaaatccaatggcaaaaactgtatttaagtctcatcgtttgtaccaaaaattaactcaaaacagatcacagattgaaatgtaaaatggaaaagcataaaaaaaaaaaacccaaaaaaacaaaacacacacacacacacaaacctttaggaaaaaaaaaaggagaaattcttcaataactaggcgaagagtttctagagttgacacagaaagcatgatccataaaaagaaaaactgataaactgaacttcatagaaatggagaacatttgctctaagaaaaatcgtgctctaagatcatgttaaaaggatgagaagataaagctacagactagaagaaactatttgctaaccacccacctgacaaaggactagtatctagaatatatgaagaactctcaaaacccaacaataaatgaacaaacaacccaattagagaatcagcaaaagacatgaagaactatttcatcaaagaggatcttacaccaaagaggacagcaaataagcacatgaaaagatgttcagcatcattagtcatcaggaaaatgcaaaataaaactacaaggtatcactacatggatatttaaaagtggctaaaataaaaaattgttgagcttctgaggacagaggagaaaaaaattaaaaaataaactgtgttaacaccaaatgctggtgagaatgcagacagactgcgtaactcatatatttctgatgggaatgttaaatgctacagctgttctggaaatcactttggcagtctgttacacagctaacatgcagttaccacaaaacccagctaatacaatcttgagcatttattgcagagaaatgaaaattgatgtttatacaaaaacctttacctgaatgtttacatcagatttactcatcagagctaaatattggaagcattccaaatgccctttaatgggcaaatggtcaaataaaatggtatatacatgccaatggaatgttactcagcaaaaaaagggaacaaatgatcaatacaagcaacttggatgaatttccaggaaattatgctgaataaaaaaaagccaacttgaaaaagttacatattgtttgatatcatttatataacattcctgaggcacatacttttaaatttataattaaaggtttatccatgttttagcatgatcagtctgtcattcttttaatagctgaataacattttattacatggatatactatattttgtttatccattagacatttgggttatttctacttttgggttatttctacttttagactattgtgaataatgctgcataaacatttgtgtatgggtttgggtagacacaggctcattaatttttaaccattcttttttctaatatatgcatttaaagatataaactttcctctaagcactgcattaactgcacgtcacatattttggaatgctgttttttgaatcatttagtttgaaatatttttctaatttccaatattatttattccccttttctcattgcttatttagaaatatattgtttaattataatatatttaaggagtctgcaggtatattttcattactgatttttaatttaattccactgtagtcagaaaacatatctggtattatttaaaaccttgaaaatttattgagacttcctttatgtcctagaatatgatctatctcggtgaaggttccatgtttgaatggaatttgtgttctgctgttgttgggtggagtattctctaaatgtcaggtcaagtttattgatattgctttcaatacgatatcctgcggttctgactacctagtctatagattaatgagaactgtgcattgaaataccattctggacataggacctggcaaagatttcatgatgaagactcaaaaagcaattgtaacaaaaacaaaaattgacaagtgggacctagttaaactaaagagtttcttcacaggaaatgaagttatcaacagaataaacagacaacctacagaatgggagaaaatatttgcaaactatgcatctgacaaaggtctaatatccataatatctaaggaacgtaaacaaattaacaaccctatttaaaaaatagactggccaggcacggtggctcacacctctaatcccagcactttgggaggccaaggcaggtggatcatgaggtcaggagatcgagaccatcctggctaacacggtgaaaccccatctctactaaaaatacaaaagaaaaaaattagccgggcatggtggcgggtgcctgtagtcccagctacttgggaggctgaggcaggagaatggcgtgaacccgggaggcatagcttgcagtgagccgagatcacgccactgcactccaacctgggcgacagagcgagactcccatctcaaaaaataataataaaataaaataaataaataaaaagaaaaaataggctaagtacatgaacagatacctctcaaaaaatgatatatatgtagccaacaagcacatgaaaaagtgctcaatatcactaatcattagagaaatgcaaaccaaaaccacaatgagatactatctcacatcagtcagaatggctattaaagtcacaaaagaatggatgctgacaaggttgtggagaaaaaggaatgcttatacactgttggtgggaatgtaaactagttcaaccactgtgaaaagcactgtggcgactccccaaaaaatgaaaacagaattaccatttgattgctgggtttatacccaatgggattgctgggtatatacccaaaggaatataaatcattttaccataatgacacatgcatgtgtgtatttatagcagcactattcacaatggcaaagatatggaatccacctagatatccatcaatggtggactggataaataaaatgtggtacatgtacaccacggaatactacacagccataaaaaagaacaaaatcatatcctttgcgtcaacatggatggagctggaggccattagcctatgctaattaatgcagggatagaaaaccaaatactacatgtcttcacatacaagtaacagctaaatattgagtacacgtggacacaaagaaggaaaacagacactggggcctacttgagggtagacataggaggagggtgaggatcaataaactacctatcgagtactatgctcattacttgggtgacaaaataatgttacaccaaatccccatgacccacaaatttacccctgtaacaaaccagcacatgtacctcctgaacctaaagtaaaagttggaaagagaaaaagaaaaaaaaaaaaatcttgaactctgattgtggatttgcctctttctcctttcagtttttgtcagttttgcttcatgtattgtgaagctttattatttaggttcacacgcctttaggactatgacatcttctagatgaatttactgtattatcatgaattgcttgtcctgaagttgactttgtctcatattaacgtagcaactccaacctacttttgactagtgtctgtatgttacgtatctttcaccatccttttgcttttaaagtatgtatcttcatttttaaattgtgattacagacaacatagttgcatcatgctttttatggtaagtttataaattgatgcctgagtctatctttttagccagcttgaaaatttctgtcttttaactgtagtataccatttacatataatgtaattaccagtatggttggatttaaatgtactatctcttttctgcttcatctcaaaattatattcttctctacattaatcattctttccatttctgaaacttacttttagcttgctcttatatatttcagcttgttcttcctggtataattcttgtcgcacttgttccaaatcttcacgttgccgcagcatttcttctaatttctgtgtcaactattaaattttttaaaaaacataaatatttataggatccaaattctgtaactaatatttcagaattttactagtgttaaagaagtggttattttaataccgcattctgaagctgtagccttttctcctcattttcttgaacttttgccatccgatcttcttctctttgctgctgcatgttagcaaactctatgatttttctgttttcttcttccatctcctcacgtttcttttttctccagagagcctgctctttctgaaactcttctatataccttcgcattgcattcattttttctaacttttgttgtttttccctgaaaagcaataacaagtacagatttatagtaaacaataaaatataaaaaagtaatttcattttgttcataataatgtacagaaaaacactatagttttttcattcgtgcatgcaacaaacattttgaatgcttactgtgtgctaaatataatgtcaggtatgaatttttctttgggtagaatactgtgatagtctcctctaacctattaatgaagttttatgcatcttatttcataaaggctacaatctgttaacattagctttgcagcactctatacttaagctgtctaccaaaaaaatttatcagaata

SEQ ID NO: 89 - DNA, 8259 bp, Homo sapiens
agagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagtttaaagaaatggctccaaaggaattgcaattcattttactatgcccctggttaaatctaactgacaggtgccgccaagcatttaactggaccataaaccaaactgagatcaaaggattcccccaccttcccataccacccagttgagagtaattcagcagctctgggtacctgacagctggccttagcccctccccgcacatagtaaaggacgagggagagcaatgtggtgtaaatgagtcaaaaaagcaccagcgactggctgtgagtcacgcagcgaggggatcgtaccctttgtttcctgcttataacctgaacactgttagactcatcagggcttccttttcaaaaagatacatggttccccttttcacatttgtggagagctcaggagatgggctgaggtcaatggcgagcttgctcctcaggagagttcacccctgattttggttgcctgttccttcttcttttggattgatgaagagcaaacccacaggatttcatactggtgaggcagcagcctggagtggccctcaaaggaggaaactgggttccaaccccggcagtactatccctcagggtgtggctggggagacagaagccacttgatatatcggagggtttcatattggatttgctgaactgaaggggctaggggagcagaggccaagggcgcccagccctgcctactggagatctcagccgcagcggggaatcctggaggctgctgcagcgtcatgctcacgtagtattctgtctgcagaggtgggctgggctggggaggcacctcaggtctcatgcctgcccgaccccagagtgatgtccttgccacctctctcccatcccaaatctcaggcagtgccacccattggaagtttctgtgcaaaccagatgcctgtggagattctgggcccagggcccggcttctccatgattcaggtgttcctggggggagggaggtgatgccaagttaaggagagagtgcatagaaatgtccacgaggcccctgcagctgcgacagtgggggctgaaaggaacatgcttgagttggaatgaataagtggggatttctgagcactgcgtcatcggtgcataagaatggggactgtggccagacacagtggctcacacctggaatcccagcactttgggaggctgaggcaggagaactgcttgaatgcaggagtttgagaccagcctcggcaacgttgggagatcccatctctacaaaaaaaaattttttttaattagctgggcatgatgatgctcgcctgtgagcccagctacttgggaggctgaggagggaggatctcttgagcccaggaggtccacactacagtgagctatgatcgtgctcctgcactccagtgtgagtgacaaagagagactccatctcttaaataaacaaaaaggatgggaactgggtacccagcacctcccctggggttcaggaggagagactcgggcagattgctcatattcccaagagtttcagacctcatcagcaggggcctggatggaggtggcagctcaggggagggtgcagcagagggagagaggaaggaagctctttccaccaggtgtggttggtcacgaaggagtgaagtctgagcttcggggacagtggttctcacctggggtgttcttgccccaccgatggcggtttggtggtgtctggacacagttttggttgtcacaacctatgcgggagtgggggtggttgctactggcatctatcgggtagagaccagggatctgcctagtgtcctgcagtgcacagggcagtccccacaaccaagagtcatgcggccccctgtgccgactgtgccaaggctgggacggaccctgctccaggacactgaagtgggggagggggagatgtattcacacaaggacttatgagctagccggcatcaggtggcatggacagttgacccaagaggatgctctcccactccattttggttttccatgggagaatcctggaaacagcactgttgctgtgacattctccttattcaccattaactgagagcaccatgggcgtgcctgggaatgagcagaaagttagatcctttttggaggtgcaaggtgagaaaggggagaaatctgtgttctctgagacatctccttacctgctttgctttatagctgagggccttgcctgcgacactctgtgggatgtgtgtgggcgtaggtagttagacacacacacacacacacacacacacacacacacacacggcggcggggggaggggtggtggtgggtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagctcctccctcgagtgctttgccgaaggggacctgcaagaacccaaaacagcagcgctgcagccagggcggtgccttctcctttcctctgtttcctgggctccaggagaattctgtcttggggtccgagaaaaactcacacagcagaccggctggcccagggctgactcagtgtttctttctctctctaggaaggcctggctggaaccagcacattttgtggaagtgggaaccaatacacgtgtacacttctctttacagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggtatgtccacctgtcctgtgcagcttccaggggccctgggacaccagagttgctc

SEQ ID NO: 90 - DNA, 11497 bp, Homo sapiens
atgatgaaactgcttctaatttatggacaaacaatatgatatctcagaatcccacagggtagttctaaccatttaatttctgcggattctcacaactgcttcagcttttctaacagaatctttggactaacatggcctctttttttgatacaaatatttttgtttggacagtgattgagactgacctggacagacctagagaatgcctctttgctgtaagattgttcctcaatctttctttcattactacttccctctaccaaggaacctttgtagacctgttttttttttcctaatttccaccacaggaacattttttattgtgctaaaatatacataacataatatttgtcattttagctatttgcaagtatactatttaatgtccttaaatgtatttacaacattgtgtaaccatcaccagtatctatacccaaaattttctcatcatccccccacataaactctgttcccgttaaacaataactccctattctccactcccccgagtccctggtaactgatagataccatgctttctgtctctgtgaaattgcctattctaggtacctcatataagtggaatcatatacaatatgtgacctgtgtctggcttattttgcttagcataatgttttcaaggtccatccatgttgtagcatgtatcaacattttactcctctttatggctgagtaatattccattgcatgcatatgccacatttgattgtttgttcacctactgatgtgtttctatatacatatatgtacatctgtgtgtgtgtatatatgtgtgtgtgtatatgtgtgtgtgtgtgtatctgtgctttctacataaaaagtgcaaaattgttttaccaccaaccccagaatgaattttcgcctgcaagaagaggggggatctcaccctcattgataacgcaggttctcaggtatagatccccaggtttcctgccaaaaatgaggtacatgtgtaggtaatgtttattattattattattattattattattattattattattttgagaccaagtctcactttgtcacccaggctggagtgcagtggtgtgatctcagctcactgcaacctctgcctcccagggtcaagtgatgcttgtgcctcagcctcccgagtagctgggattacaggcgcgcaccaccacgcccagctaatttttgtatttttaatagagatggggtttcgccatgttggccaggctggtcttgaactcctgacctcaggtgacccaccctcctcagcctccgaaagtgctgagattacagatgtgagccactgcaccctgtcagtaatatttatatgtagataaaccacttagagtgaagccaaggataaggaaaatgacctcagaacacataagtatgaaaagtcatctttattcccaatgcaatagagttatctgtattttatttagtcttcacaattgccaacagtttataaaggaatgaactcaagaatgtttggaaaacagctgtaagcagtcatgtcaggaccaagccaatggagccgatattctaactaaacttttgaaagcagtggcaattcatgatgttactattcccactgagtcaaaaatatttctggaacacaaagagaatgattaagtaagaatgtaaaataggaaaaaaaatgaaatcaatgtcacatctgaagatcagaggagtgggaagctggtacctgctagggtatgcatggttgtgtcagcatatggcatgagtgttggtgtctagttggaaggccatatggcaaggtatctggcacagactcacctaggtcttattctcctgtggttgcccaatgccatattgtctcattctgtaaagaagagatttaaaagattgttgaacagtgttaataaagtcagccatttcaaatacatgaccagattgtttaacagtgttaataaagtcagccatttcaaatacccttcaaatatcatcaaagacaagtagagactgagaaactgccagagtatgagactgcggagatgtgaagactgaagaccacatggggtcctggattggatcctggaacagagaaaggacattcacaggaatactgggaaattctgaataaagcctataatttagtactgtcatatcaatgttaattttttaattttagtcaattgtcccaggattatacaagatgttaacatgaggggaagctgagtgtgttgtgcttcttctgtgagtctaaaattatttcagaataaaaagtaaatgaaaataaacagcaaccaagtttccagtagctcctgagtatcagaagcgaacttgagactggcaaatgctgaagcatggggagagtgagggagtgtatatttgcatcatagcagctttgatgcctgccataagagtgactcctgtccttgtctcctttccgattcttttgcagggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtaagtattgtctgagggaacataaaacaagagaattactgccggcaacagtctatgcagagactgagggaaaattccactgtagcctcttcttttagccttcacacaggatctcctataaagagctccatttttaaaactacaatatgaatttaagagctgctgacagttacctgaaagttttactagtcacttggtcttgttagctagtaaaacctccaaatctaaagaggaaagaggcatgtctataaaattttatagggaaaaatgtagtgttagcaaaaaatatatattagggaaatttgtcctcattaacaacacaatgctgccttagttagctaaagggacctcaaattaaatagatacattattaaatgtaaccaatctcctttaaagtcacccagatctccactttctatgtgggtgcagtcacctgggagaggtcttactaccattctgctagagctctatctaagcagtgtgtgatgctccggccaccttgactcaccagtggctgtcacggaaagtctgaaagtggcaaagagctacaagcagtaaaagataatatttcgtggctggaaaaactcttttaacctgtgatttgatttctcttttgtttccatttatggcagagcctccatcttggcaaggcacgtaatcttatccaagctgtgcaaaacctgtccaaagtgtatgtacaataacataaaaattgaaaggtggaaaaagcgccagcacagacatgtagtgattgagtcctgcatgaaaatacatccaaaggcaagatggtttggagattttaggaagccctggctctttcctctgacacaatcacagcattctagacatccccagtaaatggactctgtgacacagacattgagcaccctgctttgtgccagacaccctgccaggagctcaatggaatcagacaaataacgcacagtgagtgcatggttactgtgcatggttactgaatcagacttttgtgtgtgtggatcctctaagattgtatgtgtcagggtattagccaatgttaaatggcgcagaggaatttgagggtttcttttctcatcagcttttgattttaatcaatgttctattagaaaaagtatcaacatttttaattctgttcaggccacagcttggggaacaagacactaatcttttaataatgttccacctgttcaatggaaatagtgatctttctccattaatttacagaagtatttagttacttgacaaaaatattttgagaacaaaatataaacctttctcagcttcttggaagaaaaactgtatttaaacttaaacgaatgtgtccaatatatgttattcaggaagtacttaagtacctgcttacacttgacttgattgatttgacagtcatttggccacagttctactacttctatgagaggatgacctgaaaaccactagagagaaatatccactctacattaatagaatactgctttttagcagctttgaatgaggagttaaaaatgaataatgaaattaaggttttttgaatgatttgtttaatttatgccattcttttaagtaacataagattgactaactttttttaaaaattcattttagatatgaaaattaagtttatgtacctaggaccatctagttagttccacaaagacagatgttttgtgccaagtaagtatcatcctcatttacaagaggggtcacaaactgctggcctcccccaacttctacctatcaagttctgttaggcctacatcgtggaatttttgtttttgaatcagtattttaaaattgggtgattttggctgggcgcagtggctcatgcctgtaatcccggcactttgggagactgaggcaggtggatcacgaggtcaagagatggagaccatcctggccaacatggtgaaatcccatctctactaaaaatacaaaaattagccaggcatggtggcgtgtgcctgtagtcccaggtactcgggaggctgaggcaggagaactgcttgaacccaggaggcagaggttgcagtgagctgagatcatgccactgcaccccagcctggcaacagaacaagactccatctcaaaaaaaaaaaaaaaaaaaataggagatttcacatgaaggccagattttcagcttcttaggaaatattttaagatctggaacacagagcccactgttctattctggtgacaatggtttagaatagagtatcagttatcccttggctgggcacggtggcttacacctgtaatctcagaactttgggaggctaaggtgggcagatcacttgagcccaggagttcaagaccagtctggccaacattgcaaaactccatctctactaaacatacaaaaatgagccgggcgtacatgcctgtaatctcagctacttgggaggctaaggcacgagaatcgcttcaacctggaggcagaggttgcagtgagccaagatcgtgccaccacactccatcctgagccacagagtgaaactctcagaaaaaaaaaaaaaaaacagaaagaaaagaaaaaagaattgagtatcagttatccactttagatgactaactttccctcgttctcacctggccactttactcagtcacattagctgcctgattctgttagctgttgagtcaaaaactactcactaaaagcagtgtgttaggatgaattgaggacatgggagtacagtactacaatcctgagtatttcacatcagttactatacaatcccccaagaagaaggaagattgcattggagccaccctcctttttccataatggtttttaatagctcaactctgtctacttgggtaacttatgttagctacaacttcaagataaaaatcacattattgcagaatcttactgctgaaagagagattggaaatcatcgaaaccgaccctttcctttcaccaaaagtaactgaggccccaaaatcttaagtgaccctccagaacaggtgatggcagagccagtgccttctaactgatgttcagtccagtctccaaatttcccctttgtataagaataccagttgtatttgattagggcccaccctgatgacctcatttgtaaatacttatctccaagtaaagtcacattctgactttaaaaccacatcctgggggttaggatttcagcatatgaatttggaagtgggggacagagttcagctcataatacttcactctctccccaccagaatacatgtccttcacccaatgaaaatattccatcccaacaaccccaaacgtctttcagacatcaactctcaagtccaaaatctcatcttaaatatcataaaattgggtatgcgtgacactcagggtatgagtcatcctgaagcaaaattgttctctagctgtgtgtgaacctgggaaaccagacaaaaagttatctgcttccaaaacagaatggtgggacaggcatagaatatacattcccattctgtaagggagaagttgcagggggaaaaaaaaagaaagaatcatggttcccaagcaagtctgaagctagcgggggaaattccattccattttaaggcttgaaaataatcctctttggctagatgttctgtcctcagggctcacaggggaggggatgcatagccctgccttccaggcacagggtcacaggagccccacccccacagccctgggcaatagttctaccctctacaaccaaggaggagccagtcgctgaaccatctttgaagccattggtccttcatttcatcctgtctctgtccctttcagtccatgctgtcaatgtttctgctggtataaaattctcaaaaaccttattggcctcccatgcaagtcatgggggtccaagcagtcagacaagagggcactccgcggatctttttcagataaccacctctctatttctggcatctactgtggaggttgattggatccgtgagtcacgtacctaatttcgttagcacatggctgtccagccacacccttggcattctctcccaatctgaggtactgagagttaagcacttcgatgtagcagtttggcggggtggagcgcggggggggacacaattcacagctgaaatatttctttacttaagctaagactttatcccaattttggtatatctgaccagtcttactaaagctacattttgtaagaccagaaatgagtcttttcaaaaccaaaaggttggtgtgaggacagagaaagtaggcaagcggggagacaggagacgtctatgtgtgcagaaacctgcacctcttctcctccagctacccgtgcaggtcatttccccccaggcccatccaggtctagcgatgtcccagcactgccccctggtggagccctccaccggcctgcaggaagggcatgtgactgactccctcagcgccctgcagtcttgtcccctctggtcccaaaagtgtatcctgccttcgctttgcgataggtttcttcctgccctttgcctggaaattttatctctggttcttgcaaacattatttacagctgtctaattttttctgtctacctcacagctgccaaactaaagtaggtgggaagccattttccctctctaggtcaatgaataccccccgttctccacccgcgcttttgaagattccagcactgctgccaagtcaacccatctgcaggagaacgctttggaaaaaacagactttaaaaagaaaagcaaactgctcttagcccctgatagcttctccacaggagagggaatatggacagagctgaggttcaagacacatgtgctgtttgagctgaatctgtgctgttttcttctttccgtggttacccaacaacgaaggcgtgttgtaccttcttgccttcaaacctgttcctcctcccgtcagatgtccttactcctcaatttgaagttttccttcataggatttctgagaaggactttggaaaaagtgctccagatctctgccagttccttagccatgaaaaccaaacataaaagatcatctggggacattcattcagagcacgttacccacattccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttcttactggtccagtacatacaagtccttcaggaagaaaaacatgattctaccaggattgggttgaatagagagagaattgcagtttaagattcatgagtatggaaataaacagctcttatggctaataaactctctatgaactttaaaaagaaaacaagaaaaaaaaaagcatggctttttaaaatccaaagtccttgccttaggaagagacaggactaaagtaaaaataaatgaagtctgtttgaaactcatgagttgcacacctcatgttgccagaagctggtttaaaaagcagtctagctgggatttccatgcaaactcagcaagtcatgaatcaacttgaagccttgtctcccagaggccataggagctgggtgtgtcccagagatgctgtgtcctgattctgtggaaagggtggggaagagaggtcactgaggatgtttctggagaaagttgtgcatggctttccttcttagctaggagggaatagggggtgtgtcaggagggtgaatgggagaagtgagggcagatgagtggatgtgtgagtagtgttagcaagccagattaaacaaactgcttgtggtttaatctgatgctcaaataaaacactttgcctgtatttctaggtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaacctgacgtctgcattgtgcatctcaaaatcctaacagcattagtatctccttttcatttttattacctgttgaaaatgggtttactgaacctggttctttcctataatttttggattttaaaaaatgtgaatctttttgataactccaaaacaaattttttttttctttttttccagatggagtctcactctgtcgcccaggctggagtacagtggcgtgatctcagctcacggcaagctccgcttcccgggttcatgccattctcctgccttctcagcctcccgagtagctgggactacaggcgcctgccacacgcccggcttattttttgtatttttagtagagacggggtttcaccttgttagccaggatggtctcgatctcctgaccttgtgatccacacgcctcggcctcccaaagtgctgggattacagacatgaaccaccgcgcccagccacaaaattgtttttaaaaaaactattttacaaaatctttgaccgtaattatttttaagatgaaaaatatgttatataaattataaaatgttacttaacacaaatataagtattgattgcccaatgttgagagagatcaacaaatgatataaaaccattcactccaaaattataattacattttaaaattaaaaaatgaaaagcattaaactttttaatttgaaaaaaatttaaactcaaaaagttaatttaaaattagttacatttaaatgtaattaaatgctaaaaatctctcttccttccgtctctctgtctctctctttctcccacacacattcactctatatgccccccatttctgaaagcaaaattgatagaaatatagaatgcatctagcagcattaccatattagtttcctaactcatggagctgggacttttaagtaggaaagtcaagcagaaatccaccaaaacagaaaagcacagcaataccacatccttggaatgactgctgcagttagtacaggatcaaagacttgaaggatccagagttggtttccatcacaactacatgtatcttacctgtctgacctctattatgggttacattgtggcactgtgtccccctaaaatttatatgttgaacccgtaacccctagtgccttagaatatgactgtttttggagacagggcctttaaagaggggattaagttaaaatgaggccattaaaatgggccctaatccaatctgagtagtatctttgtaaaaagggggaattaggacacacaaagggacaccaggaatgtacatacacagaggaaagaccatgtgagggcatgggaagaaggttgccaactgcaagccaaggagagaggactcagaggaaccaaacctgctgacaccttgatcttggacttctagccaccagaactttgagaaaataaattaatattgtttaagccaccagtcagtggactgacattttgctatgtcagtaacagcaaattaatacgaactgtgtacaaacgatggatgaattttggaggatgataaattattgtaagcttacttaggcggtggctccactgatagcagtgtttccagaagtctttttgctggagtaaaacaatataatccctgggatatcgaatgaaggtactaaaaaatttttttttgtttttgaaacggagttttgctcttgtttcccaggctggagtgcaatggcaccatctcagctccctgcaatctccgcctccctggttcaaacgattctcctgcctcaacctcccaagtagctgggattgcaggcatgcaccaccaagccctgctaattttgtacttttcgtagagacgggtttctccatgttggtcaggctggtctcaaactcccgaccttaggtgatcacccgccttggcctctcaaagtactgggattacaggcgtgagccattgcgcccgtcctaaaattttcttgtagtgggaaaatggggtggcgaggctgggcgcagagaggctggggctgcggctcagcgtgggctcccctggtgcgcagcagcagctgcgaggagctcactgcggttctagccccgccgcagctg

SEQ ID NO: 91 - DNA, 12825 bp, Homo sapiens
atgagaatgccatgctatatctagaattgctgagaagactagatgacattgtgtgctgaaggaactttgtgaaatacaaagaactacttaaacaagtagtcagcagatgacagccggtgtgccaaatccagcccaccacctggatttttgtttgtttgtttgttttatgactcaaaagctaagaatggttttcacatttttaaatagttgaaaaaatcaaaagatgaatatttcatgatgtgaaaattacatctaattcaaatttcagtgtctataaataaagttttattggaacacatccacactcgtttacatattgtctatggctgcttttgcactacaatggcggagttgagtaggtgtgatcgagaccatatgggaatatttactatctggttctttacagaaaaggtttccctactcctgacttaaattaaatatagtgacaaaaagcataaagattttggaggttttttttgagattaaaaaaaattcataagttattggcgaagtgcctgccatatagtaatggctcaataaacagatgttgctgtttatattccttcattagattattaattcaacaaatagttattgagtgcatactctgccagatactgctccaagaaccacagaatacagcaatgaacataattggacaaaattcctttgctcattgaatagacaataaacagacaaataaaaataagtagagtatattatttggctgggagaaaaaataaaggatgaaagaatagagagtttgagggtagaggttgcaatttttagatacagtggccagggaagacatcactggaaaggtgacatttgagtgaaaacccgaaggacacaagggagcccaaggggatgctgtgggggtggtgaggagtattgttctgggcaggggaataatacaaaagcctggaggcagagagagcttagagtgttcgaggaacaccaaggagttgatgggctggagtggcggggaacgatggggagaataacaggagattaaatcagaaaagtgcggggtagggccttgaagaaccatctagggactctggcttgtactctgagtgggagaggaagcaagttttgagcagaatagtggcatggcctgactcacatttaatccagatccatccgactgctccagtgcaaacaccctgtagcacagactgattaaaattttataagttgatttgcaacatcaattacagcttaatggtgttaaattgggggaatattgcatattctctccatggaaattaataaaccatttgatgggtacacagcaccttccttacattatttaagacaatgtcagaatgatgaaactgcttctaatttatggacaaacaatatgatatctcagaatcccacagggtagttctaaccatttaatttctgcggattctcacaactgcttcagcttttctaacagaatctttggactaacatggcctctttttttgatacaaatatttttgtttggacagtgattgagactgacctggacagacctagagaatgcctctttgctgtaagattgttcctcaatctttctttcattactacttccctctaccaaggaacctttgtagacctgttttttttttcctaatttccaccacaggaacattttttattgtgctaaaatatacataacataatatttgtcattttagctatttgcaagtatactatttaatgtccttaaatgtatttacaacattgtgtaaccatcaccagtatctatacccaaaattttctcatcatccccccacataaactctgttcccgttaaacaataactccctattctccactcccccgagtccctggtaactgatagataccatgctttctgtctctgtgaaattgcctattctaggtacctcatataagtggaatcatatacaatatgtgacctgtgtctggcttattttgcttagcataatgttttcaaggtccatccatgttgtagcatgtatcaacattttactcctctttatggctgagtaatattccattgcatgcatatgccacatttgattgtttgttcacctactgatgtgtttctatatacatatatgtacatctgtgtgtgtgtatatatgtgtgtgtgtatatgtgtgtgtgtgtgtatctgtgctttctacataaaaagtgcaaaattgttttaccaccaaccccagaatgaattttcgcctgcaagaagaggggggatctcaccctcattgataacgcaggttctcaggtatagatccccaggtttcctgccaaaaatgaggtacatgtgtaggtaatgtttattattattattattattattattattattattattattttgagaccaagtctcactttgtcacccaggctggagtgcagtggtgtgatctcagctcactgcaacctctgcctcccagggtcaagtgatgcttgtgcctcagcctcccgagtagctgggattacaggcgcgcaccaccacgcccagctaatttttgtatttttaatagagatggggtttcgccatgttggccaggctggtcttgaactcctgacctcaggtgacccaccctcctcagcctccgaaagtgctgagattacagatgtgagccactgcaccctgtcagtaatatttatatgtagataaaccacttagagtgaagccaaggataaggaaaatgacctcagaacacataagtatgaaaagtcatctttattcccaatgcaatagagttatctgtattttatttagtcttcacaattgccaacagtttataaaggaatgaactcaagaatgtttggaaaacagctgtaagcagtcatgtcaggaccaagccaatggagccgatattctaactaaacttttgaaagcagtggcaattcatgatgttactattcccactgagtcaaaaatatttctggaacacaaagagaatgattaagtaagaatgtaaaataggaaaaaaaatgaaatcaatgtcacatctgaagatcagaggagtgggaagctggtacctgctagggtatgcatggttgtgtcagcatatggcatgagtgttggtgtctagttggaaggccatatggcaaggtatctggcacagactcacctaggtcttattctcctgtggttgcccaatgccatattgtctcattctgtaaagaagagatttaaaagattgttgaacagtgttaataaagtcagccatttcaaatacatgaccagattgtttaacagtgttaataaagtcagccatttcaaatacccttcaaatatcatcaaagacaagtagagactgagaaactgccagagtatgagactgcggagatgtgaagactgaagaccacatggggtcctggattggatcctggaacagagaaaggacattcacaggaatactgggaaattctgaataaagcctataatttagtactgtcatatcaatgttaattttttaattttagtcaattgtcccaggattatacaagatgttaacatgaggggaagctgagtgtgttgtgcttcttctgtgagtctaaaattatttcagaataaaaagtaaatgaaaataaacagcaaccaagtttccagtagctcctgagtatcagaagcgaacttgagactggcaaatgctgaagcatggggagagtgagggagtgtatatttgcatcatagcagctttgatgcctgccataagagtgactcctgtccttgtctcctttccgattcttttgcagggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtaagtattgtctgagggaacataaaacaagagaattactgccggcaacagtctatgcagagactgagggaaaattccactgtagcctcttcttttagccttcacacaggatctcctataaagagctccatttttaaaactacaatatgaatttaagagctgctgacagttacctgaaagttttactagtcacttggtcttgttagctagtaaaacctccaaatctaaagaggaaagaggcatgtctataaaattttatagggaaaaatgtagtgttagcaaaaaatatatattagggaaatttgtcctcattaacaacacaatgctgccttagttagctaaagggacctcaaattaaatagatacattattaaatgtaaccaatctcctttaaagtcacccagatctccactttctatgtgggtgcagtcacctgggagaggtcttactaccattctgctagagctctatctaagcagtgtgtgatgctccggccaccttgactcaccagtggctgtcacggaaagtctgaaagtggcaaagagctacaagcagtaaaagataatatttcgtggctggaaaaactcttttaacctgtgatttgatttctcttttgtttccatttatggcagagcctccatcttggcaaggcacgtaatcttatccaagctgtgcaaaacctgtccaaagtgtatgtacaataacataaaaattgaaaggtggaaaaagcgccagcacagacatgtagtgattgagtcctgcatgaaaatacatccaaaggcaagatggtttggagattttaggaagccctggctctttcctctgacacaatcacagcattctagacatccccagtaaatggactctgtgacacagacattgagcaccctgctttgtgccagacaccctgccaggagctcaatggaatcagacaaataacgcacagtgagtgcatggttactgtgcatggttactgaatcagacttttgtgtgtgtggatcctctaagattgtatgtgtcagggtattagccaatgttaaatggcgcagaggaatttgagggtttcttttctcatcagcttttgattttaatcaatgttctattagaaaaagtatcaacatttttaattctgttcaggccacagcttggggaacaagacactaatcttttaataatgttccacctgttcaatggaaatagtgatctttctccattaatttacagaagtatttagttacttgacaaaaatattttgagaacaaaatataaacctttctcagcttcttggaagaaaaactgtatttaaacttaaacgaatgtgtccaatatatgttattcaggaagtacttaagtacctgcttacacttgacttgattgatttgacagtcatttggccacagttctactacttctatgagaggatgacctgaaaaccactagagagaaatatccactctacattaatagaatactgctttttagcagctttgaatgaggagttaaaaatgaataatgaaattaaggttttttgaatgatttgtttaatttatgccattcttttaagtaacataagattgactaactttttttaaaaattcattttagatatgaaaattaagtttatgtacctaggaccatctagttagttccacaaagacagatgttttgtgccaagtaagtatcatcctcatttacaagaggggtcacaaactgctggcctcccccaacttctacctatcaagttctgttaggcctacatcgtggaatttttgtttttgaatcagtattttaaaattgggtgattttggctgggcgcagtggctcatgcctgtaatcccggcactttgggagactgaggcaggtggatcacgaggtcaagagatggagaccatcctggccaacatggtgaaatcccatctctactaaaaatacaaaaattagccaggcatggtggcgtgtgcctgtagtcccaggtactcgggaggctgaggcaggagaactgcttgaacccaggaggcagaggttgcagtgagctgagatcatgccactgcaccccagcctggcaacagaacaagactccatctcaaaaaaaaaaaaaaaaaaaataggagatttcacatgaaggccagattttcagcttcttaggaaatattttaagatctggaacacagagcccactgttctattctggtgacaatggtttagaatagagtatcagttatcccttggctgggcacggtggcttacacctgtaatctcagaactttgggaggctaaggtgggcagatcacttgagcccaggagttcaagaccagtctggccaacattgcaaaactccatctctactaaacatacaaaaatgagccgggcgtacatgcctgtaatctcagctacttgggaggctaaggcacgagaatcgcttcaacctggaggcagaggttgcagtgagccaagatcgtgccaccacactccatcctgagccacagagtgaaactctcagaaaaaaaaaaaaaaaacagaaagaaaagaaaaaagaattgagtatcagttatccactttagatgactaactttccctcgttctcacctggccactttactcagtcacattagctgcctgattctgttagctgttgagtcaaaaactactcactaaaagcagtgtgttaggatgaattgaggacatgggagtacagtactacaatcctgagtatttcacatcagttactatacaatcccccaagaagaaggaagattgcattggagccaccctcctttttccataatggtttttaatagctcaactctgtctacttgggtaacttatgttagctacaacttcaagataaaaatcacattattgcagaatcttactgctgaaagagagattggaaatcatcgaaaccgaccctttcctttcaccaaaagtaactgaggccccaaaatcttaagtgaccctccagaacaggtgatggcagagccagtgccttctaactgatgttcagtccagtctccaaatttcccctttgtataagaataccagttgtatttgattagggcccaccctgatgacctcatttgtaaatacttatctccaagtaaagtcacattctgactttaaaaccacatcctgggggttaggatttcagcatatgaatttggaagtgggggacagagttcagctcataatacttcactctctccccaccagaatacatgtccttcacccaatgaaaatattccatcccaacaaccccaaacgtctttcagacatcaactctcaagtccaaaatctcatcttaaatatcataaaattgggtatgcgtgacactcagggtatgagtcatcctgaagcaaaattgttctctagctgtgtgtgaacctgggaaaccagacaaaaagttatctgcttccaaaacagaatggtgggacaggcatagaatatacattcccattctgtaagggagaagttgcagggggaaaaaaaaagaaagaatcatggttcccaagcaagtctgaagctagcgggggaaattccattccattttaaggcttgaaaataatcctctttggctagatgttctgtcctcagggctcacaggggaggggatgcatagccctgccttccaggcacagggtcacaggagccccacccccacagccctgggcaatagttctaccctctacaaccaaggaggagccagtcgctgaaccatctttgaagccattggtccttcatttcatcctgtctctgtccctttcagtccatgctgtcaatgtttctgctggtataaaattctcaaaaaccttattggcctcccatgcaagtcatgggggtccaagcagtcagacaagagggcactccgcggatctttttcagataaccacctctctatttctggcatctactgtggaggttgattggatccgtgagtcacgtacctaatttcgttagcacatggctgtccagccacacccttggcattctctcccaatctgaggtactgagagttaagcacttcgatgtagcagtttggcggggtggagcgcggggggggacacaattcacagctgaaatatttctttacttaagctaagactttatcccaattttggtatatctgaccagtcttactaaagctacattttgtaagaccagaaatgagtcttttcaaaaccaaaaggttggtgtgaggacagagaaagtaggcaagcggggagacaggagacgtctatgtgtgcagaaacctgcacctcttctcctccagctacccgtgcaggtcatttccccccaggcccatccaggtctagcgatgtcccagcactgccccctggtggagccctccaccggcctgcaggaagggcatgtgactgactccctcagcgccctgcagtcttgtcccctctggtcccaaaagtgtatcctgccttcgctttgcgataggtttcttcctgccctttgcctggaaattttatctctggttcttgcaaacattatttacagctgtctaattttttctgtctacctcacagctgccaaactaaagtaggtgggaagccattttccctctctaggtcaatgaataccccccgttctccacccgcgcttttgaagattccagcactgctgccaagtcaacccatctgcaggagaacgctttggaaaaaacagactttaaaaagaaaagcaaactgctcttagcccctgatagcttctccacaggagagggaatatggacagagctgaggttcaagacacatgtgctgtttgagctgaatctgtgctgttttcttctttccgtggttacccaacaacgaaggcgtgttgtaccttcttgccttcaaacctgttcctcctcccgtcagatgtccttactcctcaatttgaagttttccttcataggatttctgagaaggactttggaaaaagtgctccagatctctgccagttccttagccatgaaaaccaaacataaaagatcatctggggacattcattcagagcacgttacccacattccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttcttactggtccagtacatacaagtccttcaggaagaaaaacatgattctaccaggattgggttgaatagagagagaattgcagtttaagattcatgagtatggaaataaacagctcttatggctaataaactctctatgaactttaaaaagaaaacaagaaaaaaaaaagcatggctttttaaaatccaaagtccttgccttaggaagagacaggactaaagtaaaaataaatgaagtctgtttgaaactcatgagttgcacacctcatgttgccagaagctggtttaaaaagcagtctagctgggatttccatgcaaactcagcaagtcatgaatcaacttgaagccttgtctcccagaggccataggagctgggtgtgtcccagagatgctgtgtcctgattctgtggaaagggtggggaagagaggtcactgaggatgtttctggagaaagttgtgcatggctttccttcttagctaggagggaatagggggtgtgtcaggagggtgaatgggagaagtgagggcagatgagtggatgtgtgagtagtgttagcaagccagattaaacaaactgcttgtggtttaatctgatgctcaaataaaacactttgcctgtatttctaggtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaacctgacgtctgcattgtgcatctcaaaatcctaacagcattagtatctccttttcatttttattacctgttgaaaatgggtttactgaacctggttctttcctataatttttggattttaaaaaatgtgaatctttttgataactccaaaacaaattttttttttctttttttccagatggagtctcactctgtcgcccaggctggagtacagtggcgtgatctcagctcacggcaagctccgcttcccgggttcatgccattctcctgccttctcagcctcccgagtagctgggactacaggcgcctgccacacgcccggcttattttttgtatttttagtagagacggggtttcaccttgttagccaggatggtctcgatctcctgaccttgtgatccacacgcctcggcctcccaaagtgctgggattacagacatgaaccaccgcgcccagccacaaaattgtttttaaaaaaactattttacaaaatctttgaccgtaattatttttaagatgaaaaatatgttatataaattataaaatgttacttaacacaaatataagtattgattgcccaatgttgagagagatcaacaaatgatataaaaccattcactccaaaattataattacattttaaaattaaaaaatgaaaagcattaaactttttaatttgaaaaaaatttaaactcaaaaagttaatttaaaattagttacatttaaatgtaattaaatgctaaaaatctctcttccttccgtctctctgtctctctctttctcccacacacattcactctatatgccccccatttctgaaagcaaaattgatagaaatatagaatgcatctagcagcattaccatattagtttcctaactcatggagctgggacttttaagtaggaaagtcaagcagaaatccaccaaaacagaaaagcacagcaataccacatccttggaatgactgctgcagttagtacaggatcaaagacttgaaggatccagagttggtttccatcacaactacatgtatcttacctgtctgacctctattatgggttacattgtggcactgtgtccccctaaaatttatatgttgaacccgtaacccctagtgccttagaatatgactgtttttggagacagggcctttaaagaggggattaagttaaaatgaggccattaaaatgggccctaatccaatctgagtagtatctttgtaaaaagggggaattaggacacacaaagggacaccaggaatgtacatacacagaggaaagaccatgtgagggcatgggaagaaggttgccaactgcaagccaaggagagaggactcagaggaaccaaacctgctgacaccttgatcttggacttctagccaccagaactttgagaaaataaattaatattgtttaagccaccagtcagtggactgacattttgctatgtcagtaacagcaaattaatacgaactgtgtacaaacgatggatgaattttggaggatgataaattattgtaagcttacttaggcggtggctccactgatagcagtgtttccagaagtctttttgctggagtaaaacaatataatccctgggatatcgaatgaaggtactaaaaaatttttttttgtttttgaaacggagttttgctcttgtttcccaggctggagtgcaatggcaccatctcagctccctgcaatctccgcctccctggttcaaacgattctcctgcctcaacctcccaagtagctgggattgcaggcatgcaccaccaagccctgctaattttgtacttttcgtagagacgggtttctccatgttggtcaggctggtctcaaactcccgaccttaggtgatcacccgccttggcctctcaaagtactgggattacaggcgtgagccattgcgcccgtcctaaaattttcttgtagtgggaaaatggggtggcgaggctgggcgcagagaggctggggctgcggctcagcgtgggctcccctggtgcgcagcagcagctgcgaggagctcactgcggttctagccccgccgcagctg

SEQ ID NO: 92 - DNA, 22768 bp, Homo sapiens
ctggagataactgttgttaatgatttgatgcctagatgggtttactctgccttttcaatttaaataaaatcattattataatgtattttttctttacttcttgttttctttcgttctttctttcttttctttttttttttttttttgagtctgagtcttgctctatcgcccaggctggggtgcagtggcacaatctcagctctctacaacctctgcttcccaggttcaagcgattctcttgcctcagcctcccgagtagctgagattataggcgccagtcaccgtgcccagctacttcttgtattttcagcagaggcggggtttcaccatgtaggccagactggttttgaactcctgacctcaagtgatccgcccaccttggcctcccaaagtgctggaattacaggcgtgagccgccgggcctggccttttttttcttttttactggcttttgttatcttcccctacttactgatttgcttgagctctctgtggccgccactgtgtgcacccaccctctggcctgggctctgatccctggacacccaacctaggctgctgcctgaggctttgggactgaattgttgaggttgcatacggaggcagaggggagagggactttacaccatttaaacaaacacagattaaaaagcttccttgtgtgtgtcttaattgcctcaatgtgccgaagagattttccctaatttctttctgaacctccaggggctgcccctgtccccatgggcatagtttccttagacactggctcccaatcttgcgcctccggcgtcagcatcacctgggctggctcatgtgagcattaacacagatctggtggaaacacagactgccaggccctgcccctggagtctttctttgaataggcctggggtggggcccaagaatgagcagatcaacaggtttcctggtgaggctgatgccactggcccagggaccccacattgaggatggagagctttgaagattttatgcctgatgacggcaaaggacccctctcagtgggcactgaagaccagcagagtcacagaccccacgagagatgttgtcagacagacacagaggcatcacggaattaaagtgaaaatgaggaaggcaggtgagcatgtgttcatgactttcctgtgctgttttgccaaagaggctgtttaggcccaatcaggtgatgtcccattttaatcaatttcataaccagttttatttctttgatgatttgttaatttcaaaagctgtccatgcatatttgcttacagccaaaaatgactacaaaagtattatcagggaggaagaaaaagatcccttctctgtcttccaaatattccagctcccttatcagcactcaggagtcacctcttcagacctcattcagtcctttccaaacacacacgtatgtatgtgcgctttgtattcacatgactgggctagtgctgttgagactgtgtttttagtggttttgttcacatggttattaatctagaagctcctgctgtgtcggtgtccctgagccctgccaggcgctcgtagccctgccttcctgcacggggatgtgtggctcatgcccggttccccaccaagacttcaaatttgagaggctgcgttatgactggccttcactcactgtggtggacccggctcttaggccagtccttgaacatgaagtacttgcttcttaaatatttgttggaaaagaggatattgtgtaaaatgcatgaaccgtggtatacttaactgtcccagttactggacaggtgggcttttgagttaatcaacggcagcaaggctgtagtgaagtctttggatctggggtgcatctctgaggacagcgtgttaggatcctggcagcttgaagcatgttgagtgacaggtggtctcagagggctgaacagaggagttgatgagggcctgtcaattacggggggaagggtagagttaagggaaccaacattgaaaggattaaggggagggactctgcagagagtgacccaggccaagaagctggaacccgagaggcagcctcggcctagaacccgagtgacacaggccaagaagctggaacccgagaggcagcctcggcctagaaccgcagccaggggccggagtgggaggcagggccagatgtcccgctccttccaccctggtcccctgctgagccaacccagaaacctcattggggcggaaactgggcaggtgctgttggtgcaggtcagcttcctaggccgaaagcagggcaaggaagaggagaagcaatgtgcagacacactcttagaacagaattgcttcagcaagggctgtgcctgttttaagtgtatgcagctgccaagtggtctttagaaagctgtggcgatttctcctttcccctgagtgtccaagagtgttcttgcaagccctggctgagatcagtcttttcagtatttccctactcaaatgaaccaaaactctggttttcagttgtatttccccagctctcttttgagcctagtacctgttaggatgcttttggcttcaaccacaaggacactgccttctcttgcaacacaagacatctgcgggcgatgttgcagggttgcttcactgagtagctgggtgatgctgggacctagagccacttctcagaaatacattcgccttttccttcatggtcccaaggtggccccagctgctagaagtgccacggcttcacgttgcaacactcagggacatcaaggaagaggagcaaatccctgtcggcgtttccctttataagacaggaaaacatttccagaaggctccagcagagtatcgttgccatctcaccaaccagggttgcgtcacaagcccgtgccaaaccagtgatggaggatggcttgtgtagacagcagtcgcactaagcagaatcagcattgtgaagcgcaatcttaaagcaaccatatgtttatattatttgctatggcaactgggttggttgtctgagagttggaagctctgggtttctggaggacacagcatttatgagtacgaattcggatgcaaatgccttcatctgccttttgagtgttctctaaaaagtctaatttcctcggctatttaatgcacaataaaaatacagccaaatctgtactaggtctgtaaatggagagaacgtttgaaaataaatccccatgtaatccctaagtctcatttagccagtcatttcaactttcaccaccgctccactaacaaaaataaaataagataaccaaagaaaggaacaagaagtcccatggatagagttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgcccggggacggggacagaacgggagggattctcaggggcagctgtgggtttgggctgcgggggagccctggttcctgagctgaatcggggagagtcccagttcagaggagaatttatgacttggtcagaacccaggaacaatgcctcttcatgttatttatcttattttattagcagtgcacacgatcacgatcttagtgtgatctcattgtgatgttcatgttgttttgaagtgcttccttttttctcagtttataccgtttcaaataagagagtagaacttggtgagtctcggtttcccagcgttgccttatcttttcctgtgagcttttctgagctcttctgattggccatggcagcgccacacccctgcccgctggccagccaggagggctcctcagccagcttggggcttgcctggctcctccttcagacccctgcctgccctgcaaagagcagggatgctgccctcccctactaaccctgcccctccatctgcatggtaaatgccttatgctaagaattcctggagtctgttcatgccgcgtggctggtatgatgtcatatttccaaagccgacagctccctctactggcctggtctggagaactgcagtttgagtgccttgagtcagtcaatcttagacaacccaattctgtaacattttccaatttttagagcagtttgtgtttattgcctgttttttttagatggagttttgctcttgttgcccaggctggagtgcaatgatgtgatcttggctcactgcaatctccgcctcccgggttcaagtgattctcctgcctcagcctcctgagtagctgggattacaggtgcctgccactacgcccagccaattttttgtatttttagtagagacggggtttcaccatgttggccaggctggtatcgaactcctgatctcaggtcatccacccacttcggcctcccaaagtgctgggattacaggcgtgaaccattgcgctcggccagcccagctaatttttattttttgagatgggatcttgccatgttgcccaggcttgtatctaactcctaagctcaagtgatcctctagcctcagcctccctggcctcttcgggccttggcctctctgctgggattacaggcacgagccaccttgcccaccctgatactttcaataaataaacttttcccaaaggagtggtaggaatgtttcagccttttcatctaatgcatatttattgagcaccccagagcatgcagtcagttggaagttttaagcatgtgagctgggtaacgagggctgtggcggctgtgggaacccatatatgcatgggaacgtggacgatgagacaccgtgggtcaaggggcaccagggaagacctggagttggaagggatggctcatcaggtcaccaagtaaaaagaggaggcagaatattccaggtagagggactccttgtgcagaggccactagattagaggaagtgtggctcatgagtgaattacacggaatgctggctgtttgaccataaagtggattgggagggcattggcggtgagagctgagggtgaagaggtaaaaaccagctcattgaagagttgagacctcatctaaagagcagagcccatggagagtttcggatgagtagtggggatggtcagaggcccctgttggtgtcaccgtgctgctggtgtggagaatgaatgggggcagaagtgggacaaaggaggctagtcaggacaggagctgtggccccatggggacgtggtagcccaggtcagggatggagaaacaaagacagttttaggaaatttaaacttttttttgtagagatgaggtcttgccatgctgcctatgctggtctcaaattcccgtgctcaagtgatgtcagaggtgcagttggcagaatgtggtgattgcttgggtgagggaggatgtggagggcttgagactgagtccagccgtctggcttgggtgatggggtgactggtggtgttcatcactgaataagggatgtgggagaggagtagcttcggaggaaagatgttttgggtttgatgcattgagtttgtaggatacccatgatgaaatactcagtagacagatactcaggtaaaaaactgaagaaaagagatagaactggaaagagttgatgtggaagctttagagctgaaacttggatccacaggagtgtataggatcaccaaaggagagtgtatgagataaggagggggcttagcaggcagctgaggaacagcagcatttcaggaaggagagaacaggagctcagaatgttgagagggcggaaaatcagaagggtgagcatctgcatgtccatggaaagagcgtgtttcagaaaggatgaaagagaggagtgagtgggaaatgctggggagatgttgaatgtgatgagaactgacaaatcaccactgagtctcattgtaagaaggtcactggggactgctgggggtggtttcagcaaagtcagagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagtttaaagaaatggctccaaaggaattgcaattcattttactatgcccctggttaaatctaactgacaggtgccgccaagcatttaactggaccataaaccaaactgagatcaaaggattcccccaccttcccataccacccagttgagagtaattcagcagctctgggtacctgacagctggccttagcccctccccgcacatagtaaaggacgagggagagcaatgtggtgtaaatgagtcaaaaaagcaccagcgactggctgtgagtcacgcagcgaggggatcgtaccctttgtttcctgcttataacctgaacactgttagactcatcagggcttccttttcaaaaagatacatggttccccttttcacatttgtggagagctcaggagatgggctgaggtcaatggcgagcttgctcctcaggagagttcacccctgattttggttgcctgttccttcttcttttggattgatgaagagcaaacccacaggatttcatactggtgaggcagcagcctggagtggccctcaaaggaggaaactgggttccaaccccggcagtactatccctcagggtgtggctggggagacagaagccacttgatatatcggagggtttcatattggatttgctgaactgaaggggctaggggagcagaggccaagggcgcccagccctgcctactggagatctcagccgcagcggggaatcctggaggctgctgcagcgtcatgctcacgtagtattctgtctgcagaggtgggctgggctggggaggcacctcaggtctcatgcctgcccgaccccagagtgatgtccttgccacctctctcccatcccaaatctcaggcagtgccacccattggaagtttctgtgcaaaccagatgcctgtggagattctgggcccagggcccggcttctccatgattcaggtgttcctggggggagggaggtgatgccaagttaaggagagagtgcatagaaatgtccacgaggcccctgcagctgcgacagtgggggctgaaaggaacatgcttgagttggaatgaataagtggggatttctgagcactgcgtcatcggtgcataagaatggggactgtggccagacacagtggctcacacctggaatcccagcactttgggaggctgaggcaggagaactgcttgaatgcaggagtttgagaccagcctcggcaacgttgggagatcccatctctacaaaaaaaaattttttttaattagctgggcatgatgatgctcgcctgtgagcccagctacttgggaggctgaggagggaggatctcttgagcccaggaggtccacactacagtgagctatgatcgtgctcctgcactccagtgtgagtgacaaagagagactccatctcttaaataaacaaaaaggatgggaactgggtacccagcacctcccctggggttcaggaggagagactcgggcagattgctcatattcccaagagtttcagacctcatcagcaggggcctggatggaggtggcagctcaggggagggtgcagcagagggagagaggaaggaagctctttccaccaggtgtggttggtcacgaaggagtgaagtctgagcttcggggacagtggttctcacctggggtgttcttgccccaccgatggcggtttggtggtgtctggacacagttttggttgtcacaacctatgcgggagtgggggtggttgctactggcatctatcgggtagagaccagggatctgcctagtgtcctgcagtgcacagggcagtccccacaaccaagagtcatgcggccccctgtgccgactgtgccaaggctgggacggaccctgctccaggacactgaagtgggggagggggagatgtattcacacaaggacttatgagctagccggcatcaggtggcatggacagttgacccaagaggatgctctcccactccattttggttttccatgggagaatcctggaaacagcactgttgctgtgacattctccttattcaccattaactgagagcaccatgggcgtgcctgggaatgagcagaaagttagatcctttttggaggtgcaaggtgagaaaggggagaaatctgtgttctctgagacatctccttacctgctttgctttatagctgagggccttgcctgcgacactctgtgggatgtgtgtgggcgtaggtagttagacacacacacacacacacacacacacacacacacacacggcggcggggggaggggtggtggtgggtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagctcctccctcgagtgctttgccgaaggggacctgcaagaacccaaaacagcagcgctgcagccagggcggtgccttctcctttcctctgtttcctgggctccaggagaattctgtcttggggtccgagaaaaactcacacagcagaccggctggcccagggctgactcagtgtttctttctctctctaggaaggcctggctggaaccagcacattttgtggaagtgggaaccaatacacgtgtacacttctctttacagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggtatgtccacctgtcctgtgcagcttccaggggccctgggacaccagagttgctcctttatggaatatgttttgagattaatcactcccatagaaacaatgcctagttgctgcaataaataatagtttcttcactgacatatacttctgtaactatctgaggttttaaaaaagccacagcattggttcccttcaggacacccctttctgctccctgctgagctttgcagtgggtggcaccttccctcacctgctgttttcctcctgcccacccgttctacaccccaagtcctgtccatatctgttcctcctcagaaaggggtgatcccttggctgtaaatggcaagactgtgctgttgaaggtgggcgtagggatggtgggaacggcccaggccatcctaggtcactgcttgctggtgggtggcattgcatagtaacgttaggaggtgatgtggagttgcatgttaatgttgggatgtgatgtggagttgcatggtaacgttgggaggtgacgtggagttgcatggtgacgttaggaggtgacgtgttgcatggtaacgttagaaggcgatgtggagttgcttgttaacgttaggaggcgacatgttgcacggtagcattaggaagtaacatggagttgcagggtaatgttaggaggtgatccggagttacatggtaacattaagaggcaatgtggagttgcatggtaatgttagcgggtgacgtggagttgtgtggtaatgttagcgggtgacgcggagttgcgcggcgatattagcgggtgacgcggagttgcacggcgatgttagcgggtgacgcggagttgcgcggcgatgttaggcggtgacgcggagttgcgcggcgatgttagcgggtgacgcggagttgcgcggcgatgttagcgggtgacgcggagttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttagcgggtgacgtggggttgcgcggcgatgttaggcggtgacgtggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttaggcggtgacgtggagttgcgcggcgatgttagcgggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgtgcggcgatgttagcgggtgacgtggggttgcgcggcgatgttaggcggtgacgtggagttgcgcggtgatgttagcgggtgacgcggagttgcgcggcgatgttagcgggtgacgtggagttgcgcggcgatgttagcgggtgacgtggagttgcacggtgatgttaggcggtgacgtggagttgcgtggtaatgttagcgggtgacgtggagttgcgcggtgatgttagcgggtgacgtggagttgtgtggtgatgttagcgggtgatgtggagttgcgtggtaatgttaggaggcaacgtggtattgcatggtgatgtgtgtggcaatttccgttttctatgctgtgtcatagagtggaaaattctcaggctatcaacctggatcaacccctctttgtcttttgcgccatcttggagaacgcactttcctgttcccatctgtgaaatgggagtaatgacctctttctccctcacctccctgaggctaaaatgcaacaatactttatacactcctagaggctatccagcttcaatgagctactaagctaaatgccacacaactaatagctttaactcttttcttcactctgaaatagaatcaatgatcatccttcgtgcaacctcatcgggttattttgagaattaaatgagaaaatatgtgtcaagcacatgtcgtgttagattcagttagcagctgacatctcagtgaatgtgcgatgctgctttcaccattacttaattctgttattttaatttctctttatttttgttcttggcactgggttcagccagtcctgcttggcgctgcaagttcctgaagaagtggatttcctctctgtcttagttgttctgctgctataacaaaatacctcacctgtgtaatttgtaactgtagaaatttattgctcacacttggggaggctgagaagtccaagatcaaggtgccggcaggttcgatgtctgctgatgccccttccttcttactgtctcctctcatggcagaggggacaccgaggtaccctcaaaccctctttcataaggcactagtttgattcaggagggcacagccctcatgatctaatcaccccctaaaggcctcacctcttaatactattccagtgggtctgaagttccagcataggaattttggagggtcgtcaacattcagaccacagcaccacccctgtcttggttatcctgagggtggcatcagagttttcccaggcatcagtgcttccattaatgtcacttttctgttccaggacccctgctgggctcccacatttagttgtcttcttcttagttgtccccagtcttcttcttcttcttctttttttttttttttttttttttgagacagtctcactctgtcgcccaggctggagtgcggtggtgcaatctcggctcactgcaacctccacctcccgggttcaagcgattctcctgcctcagcctcccgagtagctgggattacaggcacctgccaccacgcacagctaatttttgtatttttagtagagacggtgtttcaccatgttggccaggttggtcttgaactcctgacatcccgtgatctgcccgccttagcctcccaaagttctgggattataggtgtgagccaccgcgccctgcccctcatcttcttgggtctgtgaagtttctgtcataacctgttgcccatgacgggacagtcttgattccaaccagtgtgcagcaccgcccagtctgagcccgtctgttgtttttctcgagatcaatctggagttacaggattcacaattgcttcagatttatctttctttttgctttaaccttaggggattctttagtcttaggagatgctataataaaaataagttcagtgaatgagaatagaggcttcaaagatgaaaactttcttggaaataaaaaaaaaaacataattaaaaacgagtcctatcgattgtacttttgattcagagatgatagttttattttaaaaaaacgagatatcagtttcaacagagtttcggccctgcctgccctcatcaatgagaaatggttcctactaattaaatggtaattatgtgatgcttttgtgtttggcgggagcttcagacacttttactatttctggatctagttataattgggcgtagatgtttggtaattgactttttcaactgaacatttatgatgtcagtcacatcactgcactttcccattgaattaatttgaactgcaaaccttttttaggtcagttgccctctaatcgctccgtttgactgccgtgctttcttccctgggtctcctgggggtttcaggcatgtgtgacagcatttagaggattccagaaacaccttgcacatctcttggaacgatgagtctgcgggcagtgggtttactgctgacattgctcttcccccatcagttatttggatacaaatttgacattagatttgagactctccctcccctattctccactttgcaagcccatcccccatcacagtctagaacaatccacggattattgtctgtgggatcctctagtgagtctctccctgtcctatacgaggtacagagcaggagctgaacagaaacagtccaggaaccaggacccagtttcaaattcatcttctccacttcccatctctacacctgcagcctgtcactcacctctctgggccccagtttcctcttctataaaatgaggctaatgatagcacccaccgcaggaaggtgggatgcggattgggcacgttcacaacagaacagccctcgggtgcatgctgggcttggagaagccttcggacatgttggttgtgattattgttattattatgattattggtgagtttatgtgttcaatagttatctgttaagtgaatgaaaaaatacggtttgtttttccctttgagaaatatcttgtaaatgagatacttaaactttcttaatgagggtagtaagcccctacctcagggtttttgttttttgcttttttgttctgtttttgtttgtttgttttgctttgttttgttttgttttgagacggagtctcactctgtcgcccagagtggagtgcagtggcgcgatctcggttcactgcaatctctgcctcctgggttcaagcaattctcttgcttcagcctcctgagtagctaggactacaggcatgcaccaccacatccagctaatgtttgtatttttaggagagacagggtttctccatattggccaggctggtctcaaactcctgaccttgtgatctgcatgcctcgtcctcccaaagtgctgggattacaggtgtgagccaccgcacctggccaggggtttcttaatttcagcactactaacatgcagagccagataattctttgttgtgggggctgtctttcaaattgtaggatttttagtggcatccctggcctctacccacaagatgactgtagcacctcttcagttgtgacaaccaaaaatgtctctagatgttgctcaaagtctcccaggttgggggaaaaattgcttcccatcgagaaccactgatataaataatttaaatgggaaaggatatacaaagtgagaagagacattttcccctctgtgtactcttcctcgcttgttctgtattcctccctcaaataaaagtgtgacatcttggccgggcatggtggcccacgtctgtaatctcagcactgtgggaggctgaggcgggtggatcacctgaggacaggagttcgagaccagcctggccaacatggtgaaatcccgcctctactgaaaatacaaaaaaaatttagccgggcatggtagcacaagcctgtaatcccagccactcgggaggctgaggcaagagaatcgcttgaacctaggaggcggaggttgcagtgagccgatatcatgccactgtattccagcctaggcaacagagtgagactctgtctcaaaaaaaaaaaaaaaaaaaaaagagaagtgacatcttgtttagggaacttttgagctgccctcttaagctttggttgtagtgtagaacttacggaatattttcatcttctactattactactaagcttacagttctcccaagaaaagtgggttttattttcctttgacagtagatgggtaagaattaaaaaaaaaaaaaaaagtgttgaattgcttccccaggattagtggagagcaataaggacagatgttgatatatttctaaaattcacacaaatattttaagtcttattctttccatttaaatacgtgatattaagaaaaaaataaaccatttaaagaaactaatagccagagcctttcttttagattgacacttcagattgtaataaaaagtataaccgggttctgagaggctgatcgattgcatctttggtttggcttcgtaaggagtaatgcaggctctgctgaagagcatcacaagggagttgcagaaccttgttaattcactgaaatattaatgcccacagtgacaggtctatttaaataggtggctctgagaagcgtatcgaggatgtgatttttttctgaagagaggcagaatctgtggaggttgccaggttccaggcttgcttaagggagctcactttcagacctgaagtgtggtgtaactgccgcagccttcaggaagcaaaaacaagcagcaataacctcaaatcttcctgtgattccaaggcgcaaagtggatttaaaggacggcgaggaacagagatcagagatgctcccgctgtgggtcagagggttgctcttgtctcagggaagccctgatatctctttctggaaagtcagatgatttccaaccatatagaggtttctttctgtttataaggaaaacttaaatttcctatgaagtgtgaatttgccatgtagaattgtttgaagtcattagccagagaaaggatgaaaagtcaagcattctgtgtcacctgcaaagcaaacctcgagacaaggacttgggggcaagtagttttgagggatggtggccccaggaagtggagtgagggggcagcaagtgagattgggaagaatggaagctaagaaatgtccaccaatgagcaggttcctcttgtgggcagctgggactcagaccccctggaccctccactatgaggaaaagatatcgcagagatgctgggaagtttatttcccaactccagtgcctctttgaggggagatgagaactttgagcacacttcccacctgctatgtggtgggggtggcttgtcctccctgctgggctggagcacaagctctttcttggaccctgcatccagatttgtcatcccgattatacccacaatgcccaagatacaggctggaggtggcacaaggggaggcagtgagggctggtccacagtggtctcctgtggccaggaaaggccccctggcaagagggagacctgagctagggtttgtagagtggataacatgggggtgggtgggggctggtggagaagcaggaaaggaagtgacacattcagggcttcacgctccacccacctcctgctagtcctgggcctggccatggctcccagagaaagccttcttgagaatgagtgatggaaagtatagatttttttttcccattagcacctgtttggaatgtttttggctgcaagtaacagaaatcctgactagacagtggcttaaagaaaacaggccgcatttctcagctccctggaagtctgaggttggcagtcaccctccagagctggccctggattccatgaggacaacagtggtttcctcctgtccatttggctccccttagcctgttgatctgtcaccccttgattccacgagaatcacccaatatgtgtttcagacaggaagctgcagcagcaccaaccatgctggtccctttcgtcaggaggcagaaccctctttagggctcagtcaccagtgctgggttgcttggctacttttagctgtaagggaggctggaagaatggggaacaggattgcagccgttagattccaatagtgattctcagctggaggtaatgttgccccaggggacatttggccacgtctgtagacatttttggttgtcagaactggcggactgctactggcatctagaagaaggtagagatcagggatgccgttaaatgttctccaatgcacaggacagcccacaccaaataattacctggcctaatatgtcaacagtgctgaggttcagaagtcctgggttagactgatcgtgatgcattgccaagaactgaggatgttgctgcctcaagtgaaatagaggattttgtgtagacttagagcactcaacaaggcagcgagtggacccatgggtggcagctccacttttgtccacatgattgagccctgggcaaaacaacactgggtgggagatgacgatgctggggggtctgctggcgagaagatggatacagtggcatttcagaaatcctctgtattctctggaaggtatttgtataaaatgttaataatcggtacttatcttttataatttaattgctgtgttcatgtcattaatataaccctttacagttgcttcctaaggcagcagatccctaatttatagcatgactctgattctagggctcagtggcctttgttccttagaatgtttgtattttctgagatcattttgaaaagataggtgaacatcaggacgaagagtgcaaaactttggacagatcttcctctggttttccattagcatttgaaaaatgtctctttcaggcagtgttcattaagattttaattttatagtttgttccttttttaagtgacatgcaattaattaaggtttaatgtgtcatctattttttgcaatgacacttttactgcccccttttcattttagtcagtttataaattgtactctagctaatgagttccatcctgatat
